(12) United States Patent
Olson et al.

(10) Patent No.: US 12,274,747 B2
(45) Date of Patent: Apr. 15, 2025

(54) COMPOSITIONS AND METHODS FOR TREATING CYTOKINE RELEASE SYNDROME

(71) Applicant: Regeneron Pharmaceuticals, Inc., Tarrytown, NY (US)

(72) Inventors: Kara Olson, White Plains, NY (US); Olga Sineshchekova, Pleasantville, NY (US); Eric Smith, New York, NY (US); Chia-Yang Lin, Scarsdale, NY (US)

(73) Assignee: Regeneron Pharmaceuticals, Inc., Tarrytown, NY (US)

( * ) Notice: Subject to any disclaimer, the term of this patent is extended or adjusted under 35 U.S.C. 154(b) by 0 days.

(21) Appl. No.: 17/587,501

(22) Filed: Jan. 28, 2022

(65) Prior Publication Data
US 2022/0233690 A1    Jul. 28, 2022

Related U.S. Application Data

(60) Provisional application No. 63/142,643, filed on Jan. 28, 2021.

(51) Int. Cl.
| | |
|---|---|
| A61K 39/395 | (2006.01) |
| A61K 35/17 | (2015.01) |
| A61K 38/17 | (2006.01) |
| A61P 35/00 | (2006.01) |
| A61P 37/06 | (2006.01) |

(52) U.S. Cl.
CPC .......... *A61K 39/3955* (2013.01); *A61K 35/17* (2013.01); *A61K 38/1774* (2013.01); *A61K 39/39558* (2013.01); *A61P 35/00* (2018.01); *A61P 37/06* (2018.01)

(58) Field of Classification Search
CPC ................ A61K 39/3955; A61K 35/17; A61K 38/1774; A61K 39/39558; A61P 37/06; A61P 35/00
See application file for complete search history.

(56) References Cited

U.S. PATENT DOCUMENTS

| | | |
|---|---|---|
| 4,708,871 A | 11/1987 | Geysen |
| 5,500,362 A | 3/1996 | Robinson et al. |
| 5,674,492 A | 10/1997 | Armitage et al. |
| 5,821,337 A | 10/1998 | Carter et al. |
| 5,827,642 A | 10/1998 | Riddell et al. |
| 6,040,177 A | 3/2000 | Riddell et al. |
| 6,087,329 A | 7/2000 | Armitage et al. |
| 6,797,514 B2 | 9/2004 | Berenson et al. |
| 6,867,041 B2 | 3/2005 | Berenson et al. |
| 6,905,874 B2 | 6/2005 | Berenson et al. |
| 7,575,923 B2 | 8/2009 | Dorken et al. |
| 7,635,472 B2 | 12/2009 | Kufer et al. |
| 8,669,352 B2 | 3/2014 | den Hartog et al. |
| 8,716,415 B2 | 5/2014 | Kim et al. |
| 9,125,893 B2 | 9/2015 | Endo et al. |
| 9,315,567 B2 | 4/2016 | Chang et al. |
| 9,598,494 B2 | 3/2017 | Takahashi et al. |
| 9,657,102 B2 | 5/2017 | Smith et al. |
| 10,787,521 B2 | 9/2020 | Bonvini et al. |
| 2008/0057070 A1 | 3/2008 | Long et al. |
| 2011/0195454 A1 | 8/2011 | McWhirter et al. |
| 2013/0191346 A1 | 7/2013 | Philipp et al. |
| 2014/0088295 A1 | 3/2014 | Smith et al. |
| 2014/0243504 A1 | 8/2014 | Davis et al. |
| 2016/0326249 A1 | 11/2016 | Ng et al. |
| 2017/0158771 A1 | 6/2017 | Glennie et al. |
| 2017/0320947 A1 | 11/2017 | Moore et al. |
| 2017/0342160 A1 | 11/2017 | Mertens et al. |
| 2018/0118848 A1 | 5/2018 | Haber et al. |
| 2018/0222987 A1 | 8/2018 | Albrecht et al. |
| 2018/0252727 A1 | 9/2018 | Garfall et al. |
| 2018/0305465 A1 | 10/2018 | Stevens et al. |
| 2019/0241657 A1 | 8/2019 | Albrecht et al. |
| 2019/0263920 A1 | 8/2019 | Vu et al. |
| 2019/0284279 A1 | 9/2019 | Kong et al. |
| 2019/0336504 A1 | 11/2019 | Gill et al. |
| 2020/0024356 A1 | 1/2020 | Smith et al. |
| 2020/0102403 A1 | 4/2020 | Ollier |

(Continued)

FOREIGN PATENT DOCUMENTS

| | | | | |
|---|---|---|---|---|
| PH | 12010500253 B1 | * | 2/2017 | ......... A61K 38/2013 |
| WO | WO-2000/075348 A1 | | 12/2000 | |

(Continued)

OTHER PUBLICATIONS

Chen et al., "A Modeling Framework to Characterize Cytokine Release upon T-Cell-Engaging Bispecific Antibody Treatment: Methodology and Opportunities," Clinical and Translational Science, 12(6): 600-608 (2019).

Gokbuget et al., "Blinatumomab for minimal residual disease in adults with B-cell precursor acute lymphoblastic leukemia," Blood, 131(14): 1522-1531 (2018).

International Search Report and Written Opinion for International Application No. PCT/US2022/014307 dated Jul. 14, 2022.

Li et al., "CD3 bispecific antibody-induced cytokine release is dispensable for cytotoxic T cell activity," Science Translational Medicine, 11(508): eeax8861 (2019).

Xu et al., "Cytokine release syndrome in cancer immunotherapy with chimeric antigen receptor engineered T cells," Cancer Letters, 343(2): 172-178 (2013).

(Continued)

*Primary Examiner* — Mark Halvorson
*Assistant Examiner* — Dennis J Sullivan
(74) *Attorney, Agent, or Firm* — Foley Hoag LLP; Brendan T. Jones; Mi Cai

(57) ABSTRACT

The present invention provides compositions and methods for treating cancer and inhibiting cytokine release syndrome (CRS). The methods of the present invention comprise administering to a subject in need thereof a therapeutically effective amount of a CD40 antagonist or a CAR-T cell expressing a CD40 antagonist in combination with a therapeutically effective amount of a CD3 multispecific antigen binding molecule.

33 Claims, 8 Drawing Sheets

Specification includes a Sequence Listing.

(56) References Cited

U.S. PATENT DOCUMENTS

| | | |
|---|---|---|
| 2020/0129617 A1 | 4/2020 | Brownstein et al. |
| 2020/0140552 A1 | 5/2020 | Wu et al. |
| 2020/0172627 A1 | 6/2020 | Bacac et al. |
| 2020/0172879 A1* | 6/2020 | Suri .............. C12Y 105/01003 |
| 2020/0199231 A1 | 6/2020 | Engelberts et al. |
| 2020/0277397 A1 | 9/2020 | Satijn et al. |
| 2020/0283523 A1 | 9/2020 | Liu et al. |
| 2020/0291123 A1 | 9/2020 | Park et al. |

FOREIGN PATENT DOCUMENTS

| | | |
|---|---|---|
| WO | WO-2002/011763 A1 | 2/2002 |
| WO | WO-2002/028481 A3 | 3/2003 |
| WO | WO-2003/028809 A1 | 4/2003 |
| WO | WO-2003/029296 A1 | 4/2003 |
| WO | WO-2003/045978 A2 | 6/2003 |
| WO | WO-2005/044854 A2 | 5/2005 |
| WO | WO-2006/073443 A2 | 7/2006 |
| WO | WO-2007/124299 A2 | 11/2007 |
| WO | WO-2011/123489 A2 | 10/2011 |
| WO | WO-2012/055961 A1 | 5/2012 |
| WO | WO-2012/075111 A1 | 6/2012 |
| WO | WO-2012/079000 A1 | 6/2012 |
| WO | WO-2012/129514 A1 | 9/2012 |
| WO | WO-2013/041687 A1 | 3/2013 |
| WO | WO-2013/072406 A1 | 5/2013 |
| WO | WO-2014/047231 A1 | 3/2014 |
| WO | WO-2014/140248 A1 | 9/2014 |
| WO | WO-2015/149077 A1 | 10/2015 |
| WO | WO-2016/036937 A1 | 3/2016 |
| WO | WO-2016/048938 A1 | 3/2016 |
| WO | WO-2016/081490 A1 | 5/2016 |
| WO | WO-2016/086189 A2 | 6/2016 |
| WO | WO-2016/105450 A2 | 6/2016 |
| WO | WO-2016/166629 A1 | 10/2016 |
| WO | WO-2016/196314 A1 | 12/2016 |
| WO | WO-2017/023761 A1 | 2/2017 |
| WO | WO-2017/031104 A1 | 2/2017 |
| WO | WO-2017/040566 A1 | 3/2017 |
| WO | WO-2017/053856 A1 | 3/2017 |
| WO | WO-2017/060242 A1 | 4/2017 |
| WO | WO-2017/087603 A1 | 5/2017 |
| WO | WO-2017/095267 A1 | 6/2017 |
| WO | WO-2017/096368 A1 | 6/2017 |
| WO | WO-2017/097723 A2 | 6/2017 |
| WO | WO-2017/112775 A1 | 6/2017 |
| WO | WO-2017/134134 A1 | 8/2017 |
| WO | WO-2017/210443 A1 | 12/2017 |
| WO | WO-2017/210485 A1 | 12/2017 |
| WO | WO-2018/005706 A1 | 1/2018 |
| WO | WO-2018/017786 A2 | 1/2018 |
| WO | WO-2018/058001 A1 | 3/2018 |
| WO | WO-2018/093821 A1 | 5/2018 |
| WO | WO-2018/067331 A9 | 6/2018 |
| WO | WO-2018/114748 A1 | 6/2018 |
| WO | WO-2018/188612 A1 | 10/2018 |
| WO | WO-2018/217976 A1 | 11/2018 |
| WO | WO-2018/223004 A1 | 12/2018 |
| WO | WO-2019/050521 A1 | 3/2019 |
| WO | WO-2019/075359 A1 | 4/2019 |
| WO | WO-2019/155008 A1 | 8/2019 |
| WO | WO-2019/156565 A1 | 8/2019 |
| WO | WO-2019/191120 A1 | 10/2019 |
| WO | WO-2019/210147 A1 | 10/2019 |
| WO | WO-2019/220369 A2 | 11/2019 |
| WO | WO-2019/224718 A1 | 11/2019 |
| WO | WO-2019/226761 A1 | 11/2019 |
| WO | WO-2019/228406 A1 | 12/2019 |
| WO | WO-2019/232528 A1 | 12/2019 |
| WO | WO-2019/237081 A1 | 12/2019 |
| WO | WO-2019/246356 A1 | 12/2019 |
| WO | WO-2020/006347 A1 | 1/2020 |
| WO | WO-2020/018556 A1 | 1/2020 |
| WO | WO-2020/018820 A1 | 1/2020 |
| WO | WO-2020/025596 A1 | 2/2020 |
| WO | WO-2020/048525 A1 | 3/2020 |
| WO | WO-2020/088608 A1 | 5/2020 |
| WO | WO-2020/092404 A1 | 5/2020 |
| WO | WO-2020/106620 A1 | 5/2020 |
| WO | WO-2020/135335 A1 | 7/2020 |
| WO | WO-2020/144605 A1 | 7/2020 |
| WO | WO-2020/156405 A1 | 8/2020 |
| WO | WO-2020/180726 A1 | 9/2020 |
| WO | WO-2020/191346 A1 | 9/2020 |
| WO | WO-2022/165171 A1 | 8/2022 |

OTHER PUBLICATIONS

Bankert et al., "Induction of an Altered CD40 Signaling Complex by an Antagonistic Human Monoclonal Antibody to CD40," The Journal of Immunology, 194(9): 4319-4327 (2015).

Bensinger et al., "A phase 1 study of lucatumumab, a fully human anti-CD40 antagonist monoclonal antibody administered intravenously to patients with relapsed or refractory multiple myeloma," British Journal of Haematology, 159: 58-66 (2012).

Byrd et al., "Phase I study of the anti-CD40 humanized monoclonal antibody lucatumumab (HCD122) in relapsed chronic lymphocytic leukemia," Leukemia & Lymphoma, 53(11): 15 pages (2012).

Fisher et al., "The Novel Anti-CD40 Monoclonal Antibody CFZ533 Shows Beneficial Effects in Patients with Primary Sjogren's Syndrome: A phase IIa Double-cBlind, Placebo-Controlled Randomized Trial," 2017 ACR/ARHP Annual Meeting: Abstract No. 1784 (Sep. 18, 2017).

Kahaly et al., "OR19-6 A Novel Anti-CD40 Monoclonal Antibody, Iscalimab, Successfully Treats Graves' Hyperthyroidism," Journal of the Endocrine Society, 3(Supplement1): OR19-6 (2019).

Lee et al., "Current concepts in the diagnosis and management of cytokine release syndrome," Blood, 124(2): 188-195 (2014).

Musselli et al., "BIIB063, a Potent Anti-CD40 Antagonistic Monoclonal Antibody (Mab): Lessons Learned from an Early Development Program," 2017 ACR/ARHP Annual Meeting Abstract: Abstract No. 45 (Sep. 18, 2017).

Neelapu et al., "Chimeric antigen receptor T-cell therapy—assessment and management of toxicities," Nature Reviews Clinical Oncology, 15: 47-62 (37 pages)(2018).

Neelapu et al., "Toxicity management after chimeric antigen receptor T cell therapy: one size does not fit 'ALL'," Nature Reviews Clinical Oncology, 15: 3 pages (2018).

Perper et al., "Treatment with a CD40 Antagonist Antibody Reverses Severe Proteinuria and Loss of Saliva Production and Restores Glomerular Morphology in Murine Systemic Lupus Erythematosus," The Journal of Immunology, 203(1): 58-75 (2019).

Visvanathan et al., "Treatment with BI 655064 (Antagonistic Anti-CD40 Antibody) Modulates Clinical and Biomarker Parameters Associated with Rhuematoid Arthritis (RA)," Arthritis Rheumatol. 68: 1588 (2016).

Vornhagen et al., "Cytokine release syndrome," Journal for Immunotherapy of Cancer, 6: Article 56 pp. 1-14 (2018).

Giavridis et al., "CAR T cell-induced cytokine release syndrome is mediated by macrophages and abated by IL-1 blockade." Nature Medicine 24(6) (2018): 731-738.

Guo et al., "Focused evaluation of the roles of macrophages in chimeric antigen receptor (Car) T cell therapy associated cytokine release syndrome." Cancer Biology & Medicine 19 (2022): 333.

Piechutta et al., "New emerging targets in cancer immunotherapy: the role of cluster of differentiation 40 (CD40/TNFR5)." ESMO Open 4 (2019): e000510.

Vonderheide et al., "Agonistic CD40 antibodies and cancer therapy." Clin Cancer Res. Mar. 1, 2013; 19(5): 1035-1043.

Vonderheide, "CD40 agonist antibodies in cancer immunotherapy." Annual Review of Medicine 71 (2020): 47-58.

* cited by examiner

IL-10

IL-6

IFNγ

IL-17A

COMPOSITIONS AND METHODS FOR TREATING CYTOKINE RELEASE SYNDROME

RELATED APPLICATION

This application claims the benefit of priority to U.S. Provisional Patent Application Ser. No. 63/142,643, filed Jan. 28, 2021, which is hereby incorporated by reference in its entirety.

SEQUENCE LISTING

The instant application contains a Sequence Listing which has been submitted electronically in ASCII format and is hereby incorporated by reference in its entirety. Said ASCII copy, created on Apr. 18, 2022, is named RPB-02601_SL.txt and is 691,682 bytes in size.

BACKGROUND

Cytokine release syndrome (CRS) is a systemic inflammatory response that can be triggered by a variety of factors, including certain drugs. When the symptoms associated with CRS occur less than six hours following the start of a therapeutic infusion they can be referred to as an infusion-related reaction (IRR).

T cell-activating cancer immunotherapies, including bispecific antibody therapies, carry a particularly high risk of CRS (including IRR). In such therapies, CRS can be triggered by a massive release of IFN-γ by activated T cells or by the tumor cells themselves. Secreted IFN-γ induces activation of other immune cells, including macrophages, which in turn produce excessive amounts of other cytokines, such as IL-6, TNF-α, and IL-10. In particular, IL-6 contributes to many of the key symptoms of CRS, including vascular leakage, and activation of the complement and coagulation cascade inducing disseminated intravascular coagulation. IL-6 also likely contributes to cardiomyopathy by promoting myocardial dysfunction (Shimabukaro-Vornhagen et al. (2018) *Journal for Immunotherapy of Cancer* 6:1-14).

Management of cancer immunotherapy toxicities, including CRS, is a challenging clinical problem. Mitigating CRS and/or IRR is critical for ensuring the safety of certain immunotherapy approaches, including the therapeutic use of bispecific antibodies that target T cells. While low grade CRS can generally be treated symptomatically with antihistamines, antipyretics and fluids, severe CRS can represent a life-threatening adverse event that requires prompt and aggressive treatment. Certain anti-cytokine treatments, reduced dosing of the administered therapy, and premedication with steroids are currently used to reduce the incidence of severe CRS. For example, tocilizumab, an anti-IL-6 antibody, is used as an initial treatment for severe CRS in some circumstances. However, each these currently available treatments also can reduce the therapeutic efficacy of the immunotherapy for the treatment of the cancer. Thus, there remains a need for alternative strategies to mitigate the potentially life-threatening effects of CRS without at the same time negatively impacting the therapeutic benefits of cancer immunotherapies.

SUMMARY

Provided herein are methods and compositions for the treatment and/or prevention of cytokine release syndrome (CRS), including the treatment and/or prevention of infusion-related reaction (IRR). As disclosed herein, administration of CD40 antagonists (e.g., CD40 blocking antibodies) can reduce the release of cytokines associated with CRS without affecting the T cell activation and cytotoxicity induced by administration of certain cancer immunotherapies (e.g., CD3 bispecific antibodies, CAR T cells). Thus, in certain aspects, the methods and compositions herein are able to mitigate the potentially life-threatening effects of CRS without negatively impacting the therapeutic efficacy of T cell activating cancer immunotherapies, including bispecific antibodies.

In some aspects, provided herein are methods of treating cancer and inhibiting CRS (including IRR) in a subject, comprising conjointly administering to the subject (a) a multi-specific antigen binding molecule comprising a first antigen-binding domain that specifically binds to CD3 and a second antigen-binding domain that specifically binds to a tumor antigen; and (b) a CD40 antagonist.

In some embodiments, the multi-specific antigen binding molecule and the CD40 antagonist are administered concurrently or sequentially. In some embodiments, the CD40 antagonist is administered before the multi-specific antigen binding molecule.

In some embodiments, the CD40 antagonist is an antibody or antigen-binding fragment thereof. In some embodiments, the CD40 antagonist antibody or antigen-binding fragment thereof is chimeric, humanized, composite, murine, or human. In some embodiments, the CD40 antagonist antibody or antigen-binding fragment thereof is selected from Fv, Fav, F(ab')2), Fab', dsFv, scFv, sc(Fv)2, and diabodies fragments.

In some aspects, provided herein are methods of treating cancer and inhibiting CRS (including IRR) in a subject, comprising conjointly administering to the subject (a) a multi-specific antigen binding molecule comprising a first antigen-binding domain that specifically binds CD3 and a second antigen-binding domain that specifically binds a tumor antigen; and (b) a CAR-T cell expressing a CD40 antagonist.

In some embodiments, the multi-specific antigen binding molecule and the CAR-T cell are administered concurrently or sequentially. In some embodiments, the CAR-T cell is administered before the multi-specific antigen binding molecule.

In some embodiments, the CAR-T cell secretes the CD40 antagonist. In some embodiments, the CD40 antagonist is a scFv or Fab. In some embodiments, the CAR-T cell expresses the CD40 antagonist when it is activated.

Multi-specific antigen binding molecule may be a bispecific antigen binding molecule or a tri-specific antigen binding molecule. In some embodiments, wherein the tri-specific antigen binding molecule further comprises a third antigen-binding domain that specifically binds an additional T cell antigen or an additional tumor antigen. In some embodiments, third antigen-binding domain specifically binds CD28. In some embodiments, the tumor antigen is selected from CD19, CD123, STEAP2, CD20, SSTR2, CD38, STEAP1, 5T4, ENPP3, PSMA, MUC16, GPRC5D, and BCMA.

In some embodiments, the multi-specific antigen binding molecule comprises a multi-specific antibody or antigen-binding fragment thereof. In some embodiments, the multi-specific antibody or antigen-binding fragment thereof is chimeric, humanized, composite, murine, or human. In some embodiments, the multi-specific antigen binding molecule is selected from a bispecific CD3×CD19 antibody, a bispecific CD3×GPRC5D antibody, a bispecific CD3×CD123 antibody, a bispecific CD3×STEAP2 antibody, a bispecific CD3×CD20 antibody, a bispecific CD3×SSTR 2 antibody, a bispecific CD3×CD38 antibody, a bispecific CD3×STEAP1 antibody, a bispecific CD3×5T4 antibody, a bispecific CD3×ENPP3 antibody, a bispecific CD3×MUC16 antibody, a bispecific CD3×BCMA antibody, a bispecific CD3×PSMA antibody, and a trispecific CD3×CD28×CD38 antibody.

In some embodiments, the method activates T cells and/or increases T cell cytotoxicity in the subject. In some embodiments, the method induces cancer cell death in the subject. In some embodiments, the method inhibits cytokine release syndrome. In some embodiments, the cytokine release syndrome is inhibited as measured by keeping C-reactive protein (CRP) level below 7 mg/dL, IFN-γ below 75 pg/ml, and/or IL-10 below 60 pg/ml.

In some aspects, provided herein are methods of inhibiting CRS (including IRR) caused by a multi-specific antigen binding molecule comprising a first antigen-binding domain that specifically binds CD3 and a second antigen-binding domain that specifically binds a tumor antigen in a subject, comprising administering to the subject a CAR-T cell expressing an CD40 antagonist.

In some embodiments, the subject is a human. In some embodiments, the subject is a cancer patient. In some embodiments, the methods described herein further comprises identifying a subject that is susceptible to cytokine release syndrome or in need of reduction in cytokine release prior to administering to the subject a CD40 antagonist or a CAR-T cell expressing a CD40 antagonist.

In some aspects, provided herein are pharmaceutical compositions comprising: a multi-specific antigen binding molecule comprising a first antigen-binding domain that specifically binds CD3 and a second antigen-binding domain that specifically binds a tumor antigen; and a CD40 antagonist. In some embodiments, the pharmaceutical compositions described herein further comprise a pharmaceutically acceptable carrier.

In some aspects, provided herein are methods of treating cancer and/or inhibiting CRS (including IRR) in a subject, comprising administering to the subject a pharmaceutical composition described herein. In some aspects, provided herein are methods of treating cancer and/or inhibiting CRS (including IRR) in a subject comprising: identifying a subject that is susceptible for cytokine release syndrome or in need of reduction in cytokine release; and administering to the subject a pharmaceutical composition described herein.

In some aspects, provided herein are methods of treating cancer and/or inhibiting CRS (including IRR) in a subject comprising: (a) identifying a subject that is susceptible for cytokine release syndrome or in need of reduction in cytokine release; and (b) conjointly administering to the subject (1) a multi-specific antigen binding molecule comprising a first antigen-binding domain that specifically binds to CD3 and a second antigen-binding domain that specifically binds to a tumor antigen; and (2) a CD40 antagonist.

In some aspects, provided herein are methods of treating cancer and/or inhibiting CRS (including IRR) in a subject comprising: (a) identifying a subject that is susceptible for cytokine release syndrome or in need of reduction in cytokine release; and (b) conjointly administering to the subject (1) a multi-specific antigen binding molecule comprising a first antigen-binding domain that specifically binds CD3 and a second antigen-binding domain that specifically binds a tumor antigen; and (2) a CAR-T cell expressing a CD40 antagonist.

In some embodiments, the subject susceptible for CRS and/or in need of reduction in cytokine release is identified by detecting one or more biomarkers selected from the group consisting of fever, rash, respiratory symptoms, hypoxia, hypotension, cardiovascular dysfunction, neurotoxicity, hepatic dysfunction, renal dysfunction, coagulation, organ toxicity, tumor burden, cytokines, C-reactive protein (CRP), ferritin, lactate dehydrogenase (LDH), aspartate aminotransferase (AST), blood urea nitrogen (BUN), alanine aminotransferase (ALT), creatinine (Cr), fibrinogen, Prothrombin Time (PT), Partial Thromboplastin Time (PTT), eotaxins, and endothelial cell activation.

In some embodiments, the cytokines are one or more cytokines selected from the group consisting of sTNFR2, IP10, sIL1R2, sTNFR1, MIG, VEGF, sIL1R1, TNFα, IFNα, GCSF, sRAGE, IL1, IL2, IL4, IL5, IL10, IL12, IL13, IL18, IL1R1, IFNγ, IL6, IL8, sIL2Rα, sgp130, sIL6R, MCP1, MIP1α, MIP1β, FLT-3L, fractalkine, and GM-CSF. In some embodiments, the endothelial cell activation is detected by measuring the serum level of Ang-2 and/or von Willebrand factor.

DETAILED DESCRIPTION

General

Figure 1A:
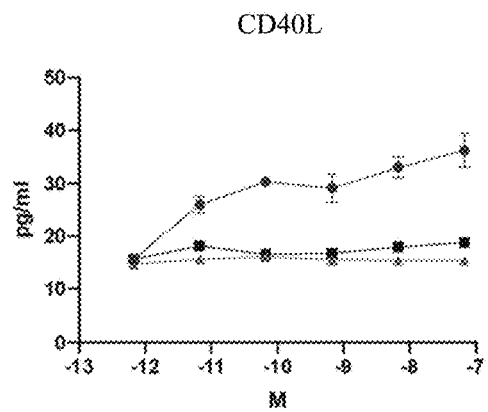
FIGS. 1A-1I show that CD40 blockade inhibited cytokine release mediated by CD123×CD3 without affecting T cell activation in 4 day assay with PBMC enriched with autologous B cells.
Figure 1B:
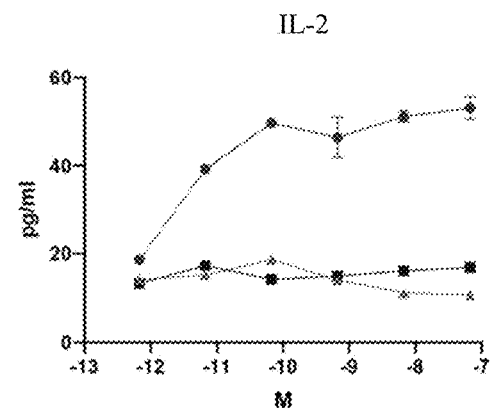
Figure 1C:
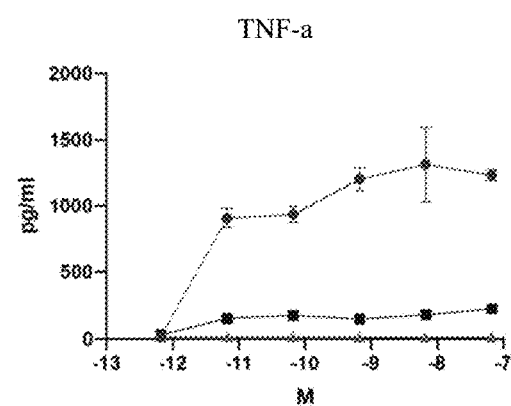
Figure 1D:
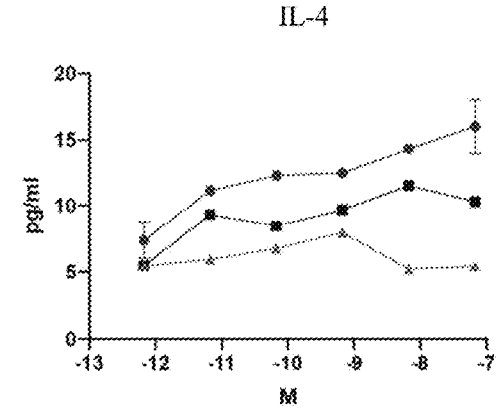
Figure 1E:
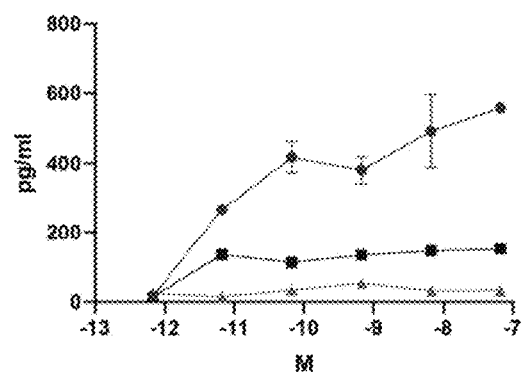
Figure 1F:
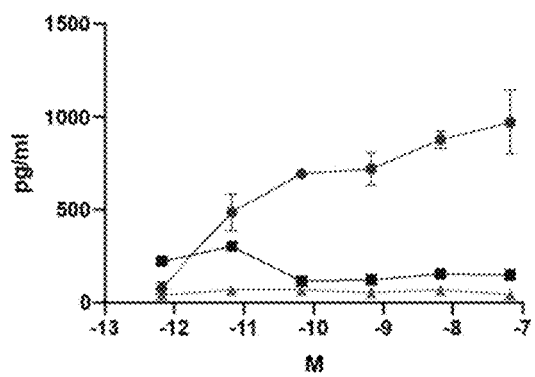
Figure 1G:
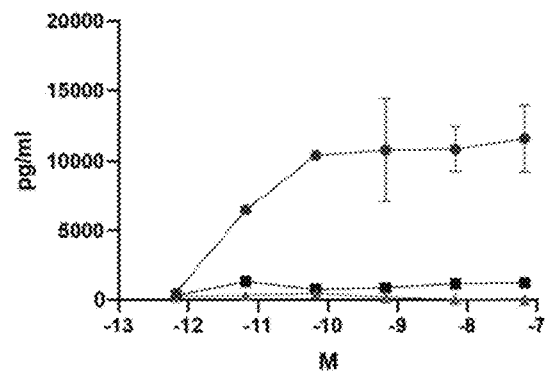
Figure 1H:
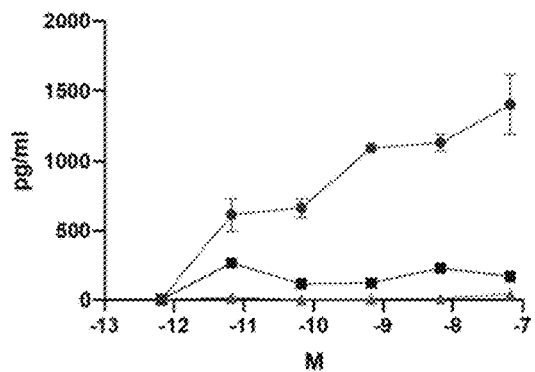
Figure 1I:
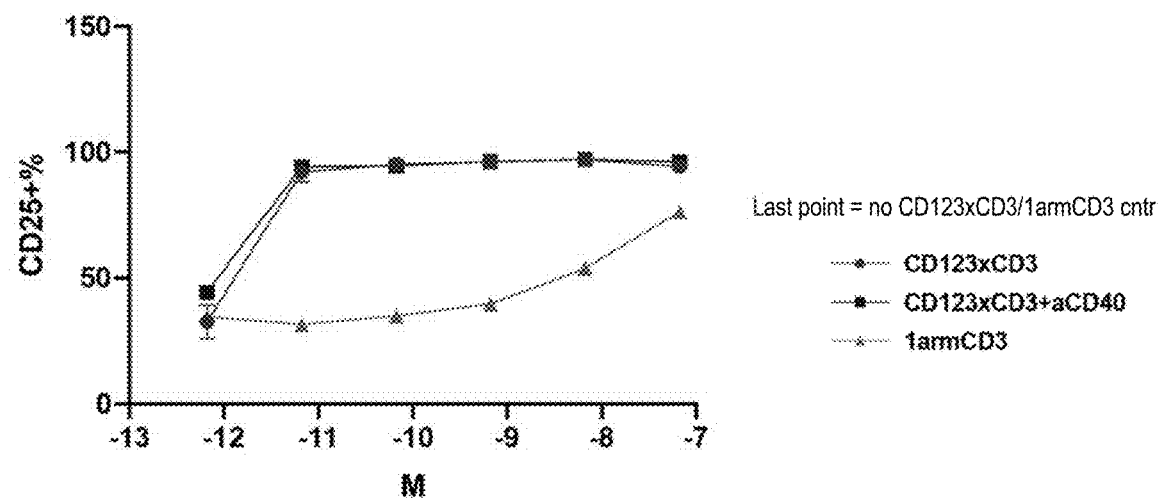
Figure 2A:
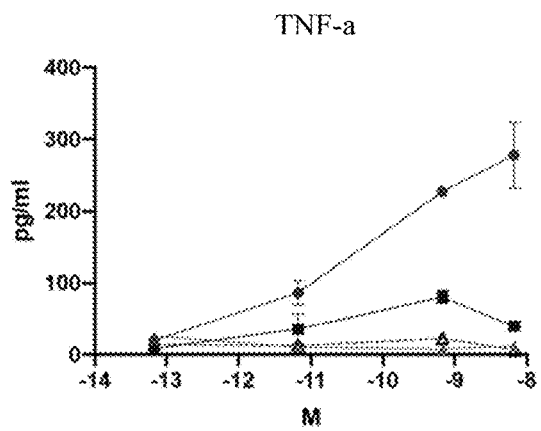
FIGS. 2A-2E show that CD40 blockade inhibited cytokine release mediated by a CD3 bispecific in a 4 day assay with AML cell line and PBMC without additional autologous B cells.
Figure 2B:
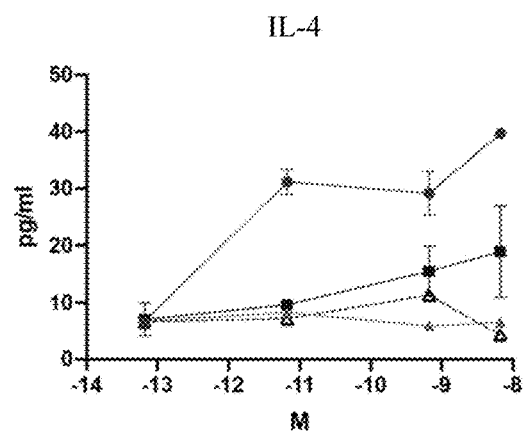
Figure 2C:
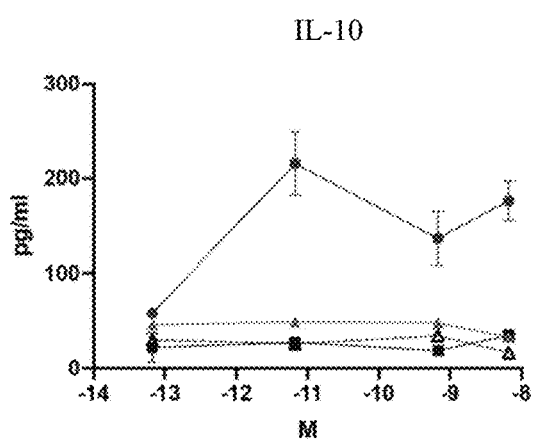
Figure 2D:
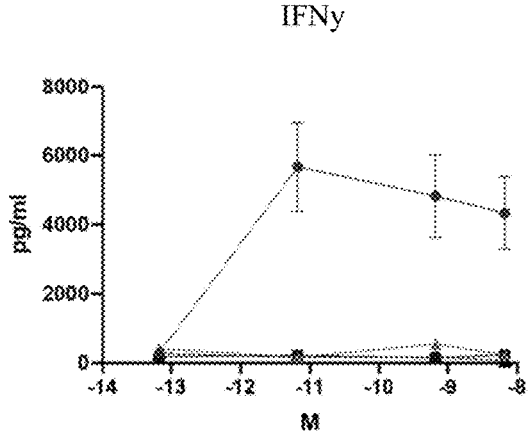
Figure 2E:
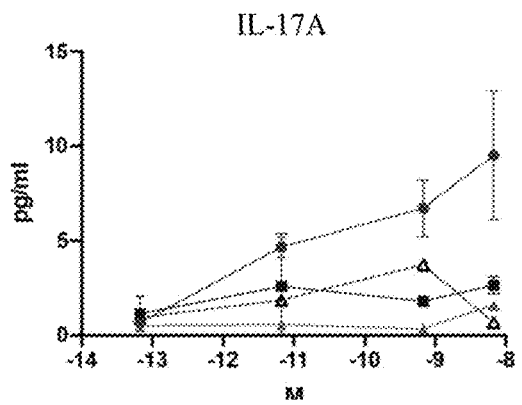
Figure 3A:
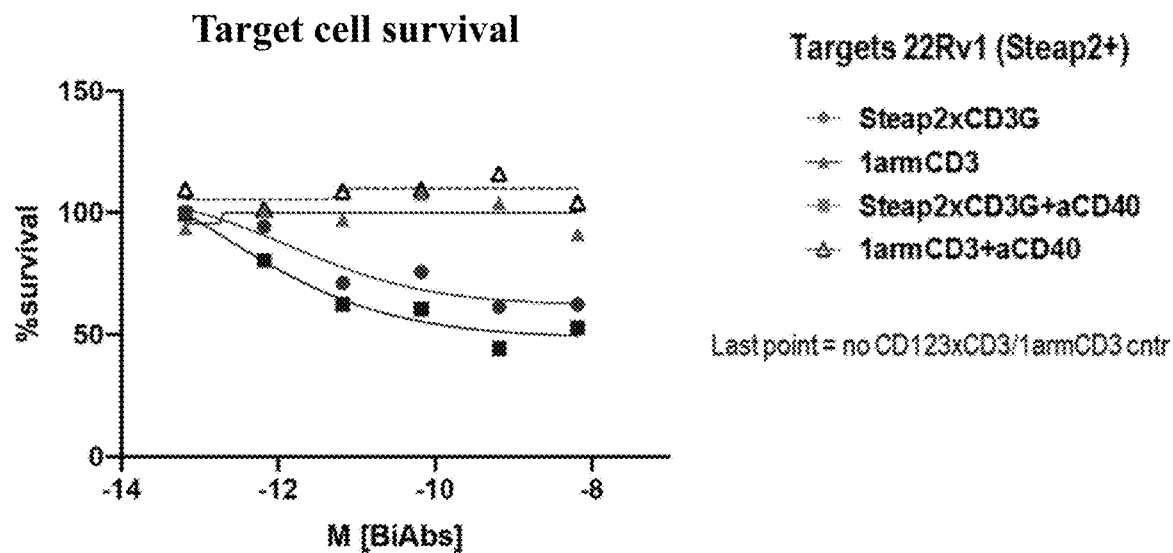
FIGS. 3A-3G show that CD40 blockade inhibited selected cytokine release mediated by CD3 bispecific without significantly affecting T cell activation and target killing in 4 day killing assay with prostatic cell line and PBMC.
Figure 3B:
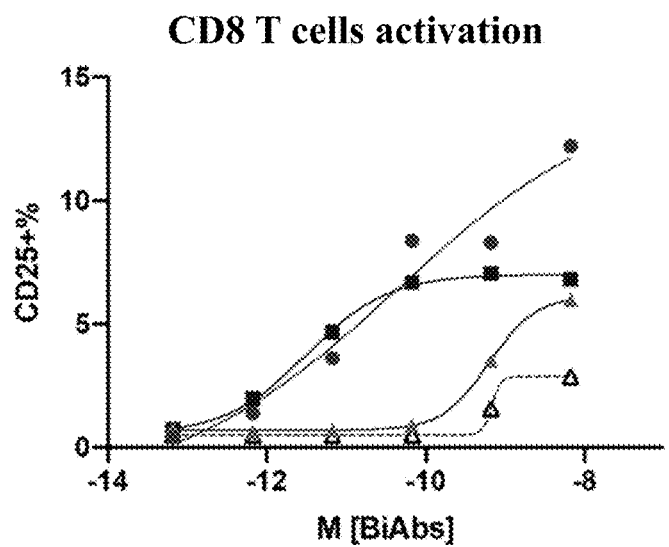
Figure 3C:
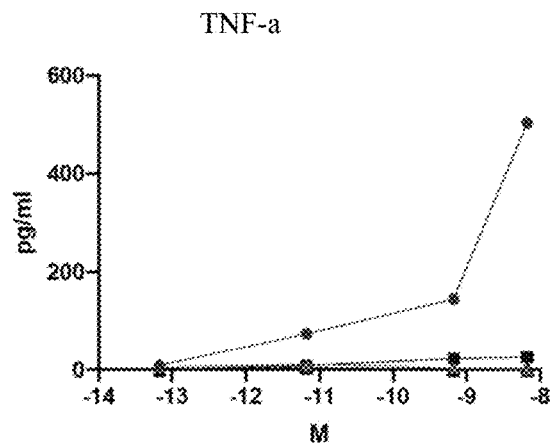
Figure 3D:
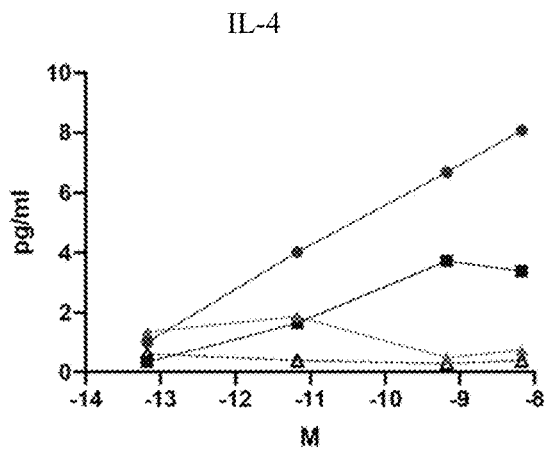
Figure 3E:
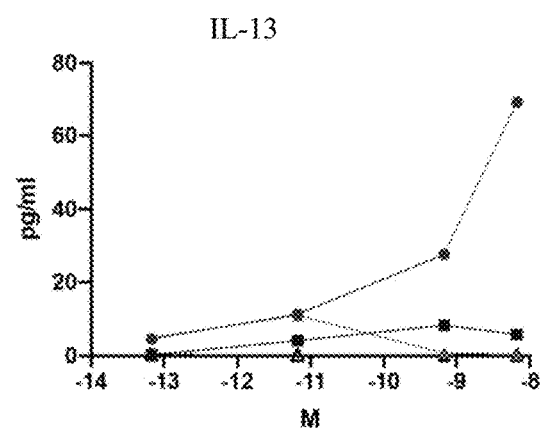
Figure 3F:
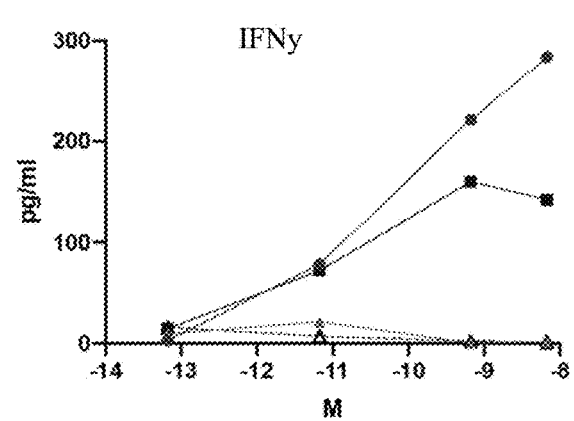
Figure 3G:
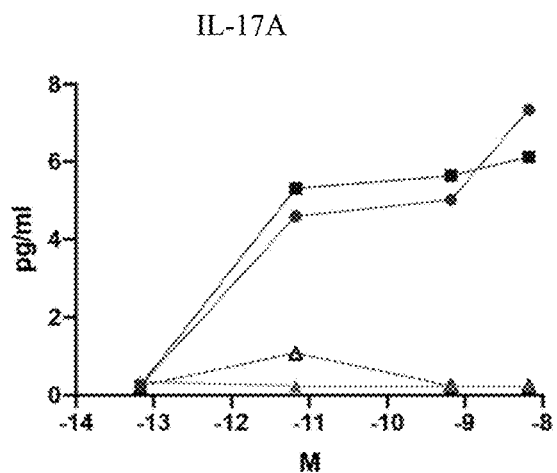

Provided herein are methods and compositions for the treatment and/or prevention of cytokine release syndrome (CRS), including the treatment and/or prevention of infusion-related reaction (IRR). As disclosed herein, administration of CD40 antagonists (e.g., CD40 blocking antibodies) can reduce the release of cytokines associated with CRS without affecting the T cell activation and cytotoxicity induced by administration of certain cancer immunotherapies (e.g., CD3 bispecific antibodies, CAR T cells). Thus, in certain aspects, the methods and compositions herein are able to mitigate the potentially life-threatening effects of CRS without negatively impacting the therapeutic efficacy of T cell activating cancer immunotherapies, including bispecific antibodies.

Accordingly, in certain aspects, provided herein are methods of treating and/or preventing CRS and/or reducing CRS-associated symptoms in a subject who is undergoing an cancer immunotherapy (e.g., with a multi-specific antigen binding molecule comprising a first antigen-binding domain that specifically binds to CD3 and a second antigen-binding domain that specifically binds to a tumor antigen) by administering to the subject a CD40 antagonist (e.g., an antagonistic antibody that binds to CD40) and/or a CAR-T cell expressing a CD40 antagonist.

In some aspects, provided herein are pharmaceutical compositions comprising: a multi-specific antigen binding molecule comprising a first antigen-binding domain that specifically binds CD3 and a second antigen-binding domain that specifically binds a tumor antigen; and a CD40 antagonist. In some embodiments, the pharmaceutical compositions described herein further comprise a pharmaceutically acceptable carrier.

It is to be understood that this disclosure is not limited to particular methods and experimental conditions described, as such methods and conditions may vary. It is also to be understood that the terminology used herein is for the purpose of describing particular embodiments only, and is not intended to be limiting, since the scope of the present invention will be limited only by the appended claims.

All patents, applications and non-patent publications mentioned in this specification are incorporated herein by reference in their entireties.

Definitions

For convenience, certain terms employed in the specification, examples, and appended claims are collected here. Unless defined otherwise, all technical and scientific terms used herein have the same meaning as commonly understood by one of ordinary skill in the art to which this invention belongs. As used herein, the term "about," when used in reference to a particular recited numerical value, means that the value may vary from the recited value by no more than 1%. For example, as used herein, the expression "about 100" includes 99 and 101 and all values in between (e.g., 99.1, 99.2, 99.3, 99.4, etc.).

The articles "a" and "an" are used herein to refer to one or to more than one (i.e., to at least one) of the grammatical object of the article. By way of example, "an element" means one element or more than one element.

As used herein, the term "administering" or "administration" means providing a pharmaceutical agent or composition to a subject, and includes, but is not limited to, administering by a medical professional and self-administering. Such an agent can contain, for example, a CAR T cell provided herein.

As used herein, the term "antibody" may refer to both an intact antibody and an antigen binding fragment thereof. Intact antibodies are glycoproteins that include at least two heavy (H) chains and two light (L) chains inter-connected by disulfide bonds. Each heavy chain includes a heavy chain variable region (abbreviated herein as $V_H$) and a heavy chain constant region. Each light chain includes a light chain variable region (abbreviated herein as $V_L$) and a light chain constant region. The $V_H$ and $V_L$ regions can be further subdivided into regions of hypervariability, termed complementarity determining regions (CDR), interspersed with regions that are more conserved, termed framework regions (FR). Each $V_H$ and $V_L$ is composed of three CDRs and four FRs, arranged from amino-terminus to carboxy-terminus in the following order: FR1, CDR1, FR2, CDR2, FR3, CDR3, FR4. The variable regions of the heavy and light chains contain a binding domain that interacts with an antigen. The term "antibody" includes, for example, monoclonal antibodies, polyclonal antibodies, chimeric antibodies, humanized antibodies, human antibodies, multispecific antibodies (e.g., bispecific antibodies, trispecific antibodies), single-chain antibodies and antigen-binding antibody fragments.

The terms "antigen binding fragment" and "antigen-binding portion" of an antibody, as used herein, refer to one or more fragments of an antibody that retain the ability to bind to an antigen. Non-limiting examples of antigen-binding fragments include: (i) Fab fragments; (ii) F(ab')2 fragments; (iii) Fd fragments; (iv) Fv fragments; (v) single-chain Fv (scFv) molecules; (vi) dAb fragments; and (vii) minimal recognition units consisting of the amino acid residues that mimic the hypervariable region of an antibody (e.g., an isolated complementarity determining region (CDR) such as a CDR3 peptide), or a constrained FR3-CDR3-FR4 peptide. Other engineered molecules, such as domain-specific antibodies, single domain antibodies, domain-deleted antibodies, chimeric antibodies, CDR-grafted antibodies, diabodies, triabodies, tetrabodies, minibodies, nanobodies (e.g. monovalent nanobodies, bivalent nanobodies, etc.), small modular immunopharmaceuticals (SMIPs), and shark variable IgNAR domains, are also encompassed within the expression "antigen-binding fragment," as used herein.

"Cancer" broadly refers to an uncontrolled, abnormal growth of a host's own cells leading to invasion of surrounding tissue and potentially tissue distal to the initial site of abnormal cell growth in the host. Major classes include carcinomas which are cancers of the epithelial tissue (e.g., skin, squamous cells); sarcomas which are cancers of the connective tissue (e.g., bone, cartilage, fat, muscle, blood vessels, etc.); leukemias which are cancers of blood forming tissue (e.g., bone marrow tissue); lymphomas and myelomas which are cancers of immune cells; and central nervous system cancers which include cancers from brain and spinal tissue. "Cancer(s)" and "neoplasm(s)"" are used herein interchangeably. As used herein, "cancer" refers to all types of cancer or neoplasm or malignant tumors including leukemias, carcinomas and sarcomas, whether new or recurring. Specific examples of cancers are: carcinomas, sarcomas, myelomas, leukemias, lymphomas and mixed type tumors. Non-limiting examples of cancers are new or recurring cancers of the brain, melanoma, bladder, breast, cervix, colon, head and neck, kidney, lung, non-small cell lung, mesothelioma, ovary, prostate, sarcoma, stomach, uterus and medulloblastoma. In some embodiments, the cancer comprises a solid tumor. In some embodiments, the cancer comprises a metastasis.

The term "chimeric antigen receptor" (CAR) refers to molecules that combine a binding domain against a component present on the target cell, for example an antibody-based specificity for a desired antigen (e.g., a tumor antigen) with a T cell receptor-activating intracellular domain to generate a chimeric protein that exhibits a specific anti-target cellular immune activity. Generally, CARs consist of an extracellular single chain antigen-binding domain (scFv) fused to the intracellular signaling domain of the T cell antigen receptor complex zeta chain, and have the ability, when expressed in T cells, to redirect antigen recognition based on the monoclonal antibody's specificity.

As used herein, the phrase "conjoint administration" or "administered conjointly" refers to any form of administration of two or more different therapeutic agents such that the second agent is administered while the previously administered therapeutic agent is still effective in the body (e.g., the two agents are simultaneously effective in the subject, which may include synergistic effects of the two agents). For example, the different therapeutic agents can be administered either in the same formulation or in separate formulations, either concomitantly or sequentially. In certain embodiments, the different therapeutic agents can be administered within about one hour, about 12 hours, about 24 hours, about 36 hours, about 48 hours, about 72 hours, or about a week of one another. Thus, a subject who receives such treatment can benefit from a combined effect of different therapeutic agents.

A "costimulatory domain" or "costimulatory molecule" refers to the cognate binding partner on a T-cell that specifically binds with a costimulatory ligand, thereby mediating a costimulatory response by the cell, such as, but not limited to proliferation. The costimulatory domain may be a human costimulatory domain. Exemplary costimulatory molecules include, CD28, 4-1BB, CD27, CD8, 4-1BB (CD137), OX40, CD30, CD40, PD-1, ICOS, lymphocyte function-associated antigen-1 (LFA-1), CD2, CD7, LIGHT, NKG2C, and B7-H3.

A "costimulatory ligand" refers to a molecule on an antigen presenting cell that specifically binds a cognate costimulatory molecule on a T-cell, thereby providing a signal which mediates a T cell response, including, but not limited to, proliferation activation, differentiation and the like. A costimulatory ligand can include but is not limited to CD7, B7-1 (CD80), B7-2 (CD86), PD-L1, PD-L2, 4-1BBL, OX40L, inducible costimulatory ligand (ICOS-L), intercellular adhesion molecule (ICAM), CD30L, CD40, CD70, CD83, HLA-G, MICA, M1CB, HVEM, lymphotoxin beta receptor, 3/TR6, ILT3, ILT4, an agonist or antibody that binds Toll ligand receptor and a ligand that specifically binds with B7-H3.

A "costimulatory signal" refers to a signal, which in combination with a primary signal, leads to T cell proliferation and/or upregulation or downregulation of key molecules.

The term "epitope" refers to an antigenic determinant that interacts with a specific antigen binding site in the variable region of an antibody molecule known as a paratope. A single antigen may have more than one epitope. Thus, different antibodies may bind to different areas on an antigen and may have different biological effects. Epitopes may be either conformational or linear. A conformational epitope is produced by spatially juxtaposed amino acids from different segments of the linear polypeptide chain. A linear epitope is one produced by adjacent amino acid residues in a polypeptide chain. In certain circumstance, an epitope may include moieties of saccharides, phosphoryl groups, or sulfonyl groups on the antigen.

As used herein, the phrase "pharmaceutically acceptable" refers to those agents, compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

As used herein, the phrase "pharmaceutically-acceptable carrier" means a pharmaceutically-acceptable material, composition or vehicle, such as a liquid or solid filler, diluent, excipient, or solvent encapsulating material, involved in carrying or transporting an agent from one organ, or portion of the body, to another organ, or portion of the body. Each carrier must be "acceptable" in the sense of being compatible with the other ingredients of the formulation and not injurious to the patient. Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, ethyl cellulose and cellulose acetate; (4) powdered tragacanth; (5) malt; (6) gelatin; (7) talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol; (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; and (22) other non-toxic compatible substances employed in pharmaceutical formulations.

The terms "polynucleotide", and "nucleic acid" are used interchangeably. They refer to a natural or synthetic molecule, or some combination thereof, comprising a single nucleotide or two or more nucleotides linked by a phosphate group at the 3' position of one nucleotide to the 5' end of another nucleotide. The polymeric form of nucleotides is not limited by length and can comprise either deoxyribonucleotides or ribonucleotides, or analogs thereof. Polynucleotides may have any three-dimensional structure, and may perform any function. The following are non-limiting examples of polynucleotides: coding or non-coding regions of a gene or gene fragment, loci (locus) defined from linkage analysis, exons, introns, messenger RNA (mRNA), transfer RNA, ribosomal RNA, ribozymes, cDNA, recombinant polynucleotides, branched polynucleotides, plasmids, vectors, isolated DNA of any sequence, isolated RNA of any sequence, nucleic acid probes, and primers. A polynucleotide may comprise modified nucleotides, such as methylated nucleotides and nucleotide analogs. If present, modifications to the nucleotide structure may be imparted before or after assembly of the polymer. A polynucleotide may be further modified, such as by conjugation with a labeling component. In all nucleic acid sequences provided herein, U nucleotides are interchangeable with T nucleotides. The polynucleotide is not necessarily associated with the cell in which the nucleic acid is found in nature, and/or operably linked to a polynucleotide to which it is linked in nature.

As used herein, a therapeutic that "prevents" a condition refers to a compound that, when administered to a statistical sample prior to the onset of the disorder or condition, reduces the occurrence of the disorder or condition in the treated sample relative to an untreated control sample, or delays the onset or reduces the severity of one or more symptoms of the disorder or condition relative to the untreated control sample.

The term "substantial identity" or "substantially identical," when referring to a nucleic acid or fragment thereof, indicates that, when optimally aligned with appropriate nucleotide insertions or deletions with another nucleic acid (or its complementary strand), there is nucleotide sequence identity in at least about 95%, and more preferably at least about 96%, 97%, 98% or 99% of the nucleotide bases, as measured by any well-known algorithm of sequence identity, such as FASTA, BLAST or Gap, as discussed below. A nucleic acid molecule having substantial identity to a reference nucleic acid molecule may, in certain instances, encode a polypeptide having the same or substantially similar amino acid sequence as the polypeptide encoded by the reference nucleic acid molecule.

As applied to polypeptides, the term "substantial similarity" or "substantially similar" means that two peptide sequences, when optimally aligned, such as by the programs GAP or BESTFIT using default gap weights, share at least 95% sequence identity, even more preferably at least 98% or 99% sequence identity. Preferably, residue positions which are not identical differ by conservative amino acid substitutions. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein. In cases where two or more amino acid sequences differ from each other by conservative substitutions, the percent sequence identity or degree of similarity may be adjusted upwards to correct for the conservative nature of the substitution. Means for making this adjustment are well-known to those of skill in the art. See, e.g., Pearson (1994) Methods Mol. Biol. 24: 307-331, herein incorporated by reference. Examples of groups of amino acids that have side chains with similar chemical properties include (1) aliphatic side chains: glycine, alanine, valine, leucine and isoleucine; (2) aliphatic-hydroxyl side chains: serine and threonine; (3) amide-containing side chains: asparagine and glutamine; (4) aromatic side chains: phenylalanine, tyrosine, and tryptophan; (5) basic side chains: lysine, arginine, and histidine; (6) acidic side chains: aspartate and glutamate, and (7) sulfur-containing side chains are cysteine and methionine. Preferred conservative amino acids substitution groups are: valine-leucine-isoleucine, phenylalanine-tyrosine, lysine-arginine, alanine-valine, glutamate-aspartate, and asparagine-glutamine. Alternatively, a conservative replacement is any change having a positive value in the PAM250 log-likelihood matrix disclosed in Gonnet et al. (1992) Science 256: 1443-1445, herein incorporated by reference. A "moderately conservative" replacement is any change having a nonnegative value in the PAM250 log-likelihood matrix.

The term "specifically binds" or "specific binding", as used herein, when referring to a polypeptide refers to a binding reaction which is determinative of the presence of the protein or polypeptide or receptor in a heterogeneous population of proteins and other biologics. Thus, under designated conditions (e.g. immunoassay conditions in the case of an antibody), a specified ligand or antibody "specifically binds" to its particular "target" (e.g. an antibody specifically binds to an endothelial antigen) when it does not bind in a significant amount to other proteins present in the sample or to other proteins to which the ligand or antibody may come in contact in an organism. Generally, a first molecule that "specifically binds" a second molecule has an affinity constant (Ka) greater than about $10^5$ M$^{-1}$ (e.g., $10^6$ M$^{-1}$, $10^7$ M$^{-1}$, $10^8$ M$^{-1}$, $10^9$ M$^{-1}$, $10^{10}$ M$^{-1}$, $10^{11}$ M$^{-1}$, and $10^{12}$ M$^{-1}$ or more) with that second molecule. For example, in the case of the ability of a PIG-specific CAR to bind to a peptide presented on an MHC (e.g., class I MHC or class II MHC); typically, a CAR specifically binds to its peptide/MHC with an affinity of at least a KD of about 10–4 M or less, and binds to the predetermined antigen/binding partner with an affinity (as expressed by KD) that is at least 10 fold less, at least 100 fold less or at least 1000 fold less than its affinity for binding to a non-specific and unrelated peptide/MHC complex (e.g., one comprising a BSA peptide or a casein peptide).

As used herein, the term "subject" means a human or non-human animal selected for treatment or therapy.

As used herein, the term "treatment" refers to clinical intervention designed to alter the natural course of the individual being treated during the course of clinical pathology. Desirable effects of treatment include decreasing the rate of progression, ameliorating or palliating the pathological state, and remission or improved prognosis of a particular disease, disorder, or condition. An individual is successfully "treated," for example, if one or more symptoms associated with a particular disease, disorder, or condition are mitigated or eliminated.

Cytokine Release Syndrome (CRS)

General

In certain aspects, provided herein are methods and compositions for treating and/or preventing cytokine release syndrome (CRS). The symptoms associated with CRS can include infusion-related reaction (IRR) if they occur less than six hours following the start of a therapeutic infusion. Thus, in certain embodiments, the methods and compositions provided herein can be useful in treating and/or preventing CRS and/or CRS symptoms, including, but not limited to, IRR.

CRS is a potentially life-threatening cytokine-associated toxicity that can occur as a result of cancer immunotherapy, e.g., cancer antibody therapies (e.g., bispecific antibodies) and/or T cell immunotherapies (e.g., CAR T cells). CRS results from high-level immune activation when large numbers of lymphocytes and/or myeloid cells release inflammatory cytokines upon activation. The severity of CRS and the timing of onset of symptoms can vary depending on the magnitude of immune cell activation, the type of therapy administered, and/or the extent of tumor burden in a subject. In the case of T-cell therapy for cancer, symptom onset is typically days to weeks after administration of the T-cell therapy, e.g., when there is peak in vivo T-cell expansion. See, e.g., Lee et al. (2014) Blood. 124:188-195.

Symptoms of CRS can include neurologic toxicity, disseminated intravascular coagulation, cardiac dysfunction, adult respiratory distress syndrome, renal failure, and/or hepatic failure. For example, symptoms of CRS can include fever with or without rigors, fatigue, malaise, myalgias, vomiting, headache, nausea, anorexia, arthalgias, diarrhea, rash, hypoxemia, tachypnea, hypotension, widened pulse pressure, potentially diminished cardiac output (late), increased cardiac output (early), azotemia, hypofibrinogenemia with or without bleeding, elevated D-dimer, hyperbilirubinemia, transaminitis, confusion, delirium, mental status changes, hallucinations, tremor, seizures, altered gait, word finding difficulty, frank aphasia, or dymetria.

CRS Grading

In certain aspects, the methods and compositions provided herein can be used to treat and/or prevent CRS of any degree of severity. In certain embodiments, the methods and compositions provided herein are used in the treatment and/or prevention of severe CRS.

The management of CRS may follow a grade- and risk-adapted strategy for monitoring and therapy. Several CRS grading systems have been developed and disclosed in, e.g., Porter et al. (2018) J. Hematol Oncol. 11:35, Lee et al. (2014) Blood 124:188-195, Neelapu et al. (2018) Nat. Rev. Clin. Oncol. 15:47-62, Neelapu et al. (2018) Nat. Rev. Clin. Oncol. 15:218, Teachey et al. (2016) Cancer Discov. 6:664-679, and U.S. Patent Application Publication No. 2019/0336504, each of which is incorporated by reference herein in its entirety. Any of these CRS grading system may be used to evaluate, diagnose, stratify, or identify subjects for the methods provided herein.

In some embodiments, CRS can be graded in severity from 1-5 as follows. Grades 1-3 are less than severe CRS. Grades 4-5 are severe CRS. For Grade 1 CRS, only symptomatic treatment is needed (e.g., nausea, fever, fatigue, myalgias, malaise, headache) and symptoms are not life threatening. For Grade 2 CRS, the symptoms require moderate intervention and generally respond to moderate intervention. Subjects having Grade 2 CRS develop hypotension that is responsive to either fluids or one low-dose vasopressor; or they develop grade 2 organ toxicity or mild respiratory symptoms that are responsive to low flow oxygen (<40% oxygen). In Grade 3 CRS subjects, hypotension generally cannot be reversed by fluid therapy or one low-dose vasopressor. These subjects generally require more than low flow oxygen and have grade 3 organ toxicity (e.g., renal or cardiac dysfunction or coagulopathy) and/or grade 4 transaminitis. Grade 3 CRS subjects require more aggressive intervention, e.g., oxygen of 40% or higher, high dose vasopressor(s), and/or multiple vasopressors. Grade 4 CRS subjects suffer from immediately life-threatening symptoms, including grade 4 organ toxicity or a need for mechanical ventilation. Grade 4 CRS subjects generally do not have transaminitis. In Grade 5 CRS subjects, the toxicity causes death. For example, criteria for grading CRS is disclosed in U.S. Patent Application Publication No. 2019/0336504, which is incorporated by reference herein in its entirety.

In certain embodiments, the methods and/or compositions provided herein treat and/or prevent grade 5 CRS. In certain embodiments, the methods and/or compositions provided herein treat and/or prevent grade 4 CRS. In certain embodiments, the methods and/or compositions provided herein treat and/or prevent grade 3 CRS. In certain embodiments, the methods and/compositions provided herein treat and/or prevent grade 2 CRS. In certain embodiments, the methods and/compositions provided herein treat and/or prevent grade 1 CRS.

Identifying a Subject at Risk for CRS

In certain embodiments, the methods provided herein include the treatment of a subject susceptible for CRS and/or in need of reduction in cytokine release. In some embodiments, the methods provided herein comprise identifying a subject susceptible for CRS and/or in need of reduction in cytokine release.

In some embodiments, one or more biomarkers are used to evaluate (e.g., diagnose or identify) a subject susceptible for CRS or in need of reduction in cytokine release. In some embodiments, the one or more biomarkers are selected from fever, rash, respiratory symptoms, hypoxia, hypotension, cardiovascular dysfunction, neurotoxicity, hepatic dysfunction, renal dysfunction, coagulation, organ toxicity, tumor burden, cytokines, eotaxins, C-reaction protein (CRP), ferratin, creatinine, and endothelial cell activation, etc.

In certain embodiments, the exemplary cytokines include, but are not limited to, e.g., sTNFR2, IP10, sIL1R2, sTNFR1, MIG, VEGF, sIL1R1, TNFα, IFNα, GCSF, sRAGE, IL2, IL4, IL5, IL10, IL12, IL13, IL18, IL1R1, IFNγ, IL6, IL8, sIL2Rα, sgp130, sIL6R, MCP1, MIP1α, MIP1β, FLT-3L, fractalkine, and GM-CSF. In some embodiments, one or more (e.g., two or more, or three or more) of the cytokines, sTNFR2, IP10, sIL1R2, sTNFR1, MIG, VEGF, sIL1R1, TNFα, IFNα, GCSF, sRAGE, IL1, IL2, IL4, IL5, IL10, IL12, IL13, IL18, IL1R1, IFNγ, IL6, IL8, sIL2Rα, sgp130, sIL6R, MCP1, MIP1α, MIP1β, FLT-3L, fractalkine, and GM-CSF, are used to evaluate (e.g., diagnose or identify) a subject susceptible for CRS or in need of reduction in cytokine release.

Exemplary biomarkers used to evaluate (e.g., predict) CRS severity can also include disease burden assessments, e.g., the extent of disease (e.g., cancer) in a subject. For example, a disease burden assessment can be made by determining the level of disease (e.g., cancer) in a biological sample from a subject. For example, a high disease burden is indicated by the presence of at least 25% (e.g., 25%, 30%, 35%, 40%, 45%, 50%, 55%, 60%, 70%, 80%, 90% or higher) cancer cells in a biological sample obtained from a subject (e.g., determined by morphology on an aspirate or biopsy, a flow assay on an aspirate or biopsy, and/or by MRD). In some embodiments, a high disease burden is indicated by the presence of at least 50% cancer cells in a biological sample obtained from a subject. For example, a low disease burden is indicated by the presence of less than 25% (e.g., 24%, 23%, 22%, 21%, 20%, 15%, 10%, 5% or less) cancer cells in a biological sample obtained from a subject (e.g., determined by morphology on an aspirate or biopsy, a flow assay on an aspirate or biopsy, and/or by MRD). In some embodiments, a low disease burden is indicated by the presence of less than 0.1%, 1%, 5%, 10%, 15%, 20%, or 25% cancer cells in a biological sample obtained from a subject.

In some embodiments, one or more cytokines in combination with a disease burden assessment is used to evaluate (e.g., diagnose or identify) a subject susceptible for CRS or in need of reduction in cytokine release.

Another exemplary biomarker used to evaluate (e.g., diagnose or identify) a subject susceptible for CRS or in need of reduction in cytokine release includes C-reactive protein (CRP) level or activity. In embodiments, a subject at low risk of severe CRS is identified as having a CRP level of less than 7 mg/dL (e.g., 7, 6.8, 6, 5, 4, 3, 2, 1 mg/dL or less). In some embodiments, a subject at high risk of severe CRS is identified as having a greater level of CRP in a sample (e.g., a blood sample) compared to a subject at low risk of severe CRS or compared to a control level or activity. In some embodiments, the greater level or activity is at least 2-fold greater (e.g., at least 2, 3, 4, 5, 6, 7, 8, 9, 10, 15, 20, 25, 30, 40, 50, 100, 500, 1000-fold or more greater) compared to a subject at low risk of severe CRS or compared to a control level or activity.

In some embodiments, one or more biomarkers described herein are used to predict CRS risk or severity in a subject early on after administration with the CD40 antagonist and/or CD3 multispecific antibody described herein. In some embodiments, one or more biomarkers described herein are used to predict CRS risk or severity in a subject within 2 weeks, e.g., within 1 week or less after administration with the CD40 antagonist and/or CD3 multispecific antibody described herein. In embodiments, the biomarkers described herein are used to predict CRS risk or severity in a subject within 10 days (e.g., 10, 9, 8, 7, 6, 5, 4, 3, 2, 1 day or less after administration with the CD40 antagonist and/or CD3 multispecific antibody described herein. In embodiments, the biomarkers described herein are used to predict CRS risk or severity in a subject within 1-10 days (e.g., within 1-10, 1-9, 1-8, 1-7, 1-6, 1-5, 1-4, 1-3, 1-2, or 1 day after administration with the CD40 antagonist and/or CD3 multispecific antibody described herein. In embodiments, the biomarkers described herein are used to predict CRS risk or severity in a subject before the subject experiences one or more symptoms of grade 2, 3, 4, or 5 CRS (e.g., before the subject experiences one or more symptoms of grade 3, 4, or 5 CRS, or grade 4 or 5 CRS).

In some embodiments, elevated or reduced levels of one or more of the cytokines described herein, e.g., sTNFR2, IP10, sIL1R2, sTNFR1, VEGF, sIL1R1, TNFα, IFNα, GCSF, sRAGE, IL1, IL2, IL4, IL5, IL10, IL12, IL13, IL18, IL1R1, IFNγ, IL6, IL8, sIL2Rα, sgp130, sIL6R, MCP1, MIP1α, MIPβ, FLT-3L, fractalkine, and GM-CSF, relative to a control level, indicate that the subject is susceptible for CRS or in need of reduction in cytokine release, or at risk of developing severe CRS. The control level may be a reference level, a baseline level, a level from a healthy subject, a level from a subject having disorder or condition (e.g., cancer) other than CRS, a level from a subject prior to administration of the CD3 mulitspecific antibody and/or CD40 antagonist described herein, or a subject with a specific grade of CRS.

In some embodiments, an elevation of one or more of the cytokines described herein (e.g., one or more of IFNγ, IL6, IL10, sgp130, IL18, TNFα, IL8, IP10, MCP1, MIG, MIP1β, and sIL6R) by at least 2-fold (e.g., 2, 3, 4, 5, 6, 7, 8, 9, 10, 50, 100, 500, 1000-fold or more) relative to a control level (e.g., a baseline level), indicate that the subject is susceptible for CRS or in need of reduction in cytokine release, or at risk of developing severe CRS.

In some embodiments, a reduction of one or more of the cytokines described herein (e.g., one or more of IL1R1, MIP1α, and IL13) by at least 10% (e.g., at least 20%, 30%, 40%, 50%, 60%, 70%, 80%, 90%, 95%, or 99%) relative to a reference level, indicate that the subject is susceptible for CRS or in need of reduction in cytokine release, or at risk of developing severe CRS. In some embodiments, the reference level is a value that does not depend on the baseline level of the cytokine in the subject. In some embodiments, the reference level is baseline cytokine value or baseline cytokine values by disease burden.

In some embodiments, an elevation of one or more of cytokines described herein (e.g., IFNγ, IL6, IL10, sgp130, IL18, TNFα, IL8, IP10, MCP1, MIG, MIP1β, and sIL6R), e.g., by at least 2-fold (e.g., 2, 3, 4, 5, 6, 7, 8, 9, 10, 50, 100, 500, 1000-fold or more) relative to a control level, e.g., when measured within 1-10 days (e.g., within 1-10, 1-9, 1-8, 1-7, 1-6, 1-5, 1-4, 1-3, 1-2, or 1 day) after administration with a CD3 multispecific antibody described herein, indicate that the subject is susceptible for CRS or in need of reduction in cytokine release, or at risk of developing severe CRS.

In some embodiments, a CRP level of less than 7 mg/dL (e.g., 7, 6.8, 6, 5, 4, 3, 2, 1 mg/dL or less), e.g., when measured within 1-10 days (e.g., within 1-10, 1-9, 1-8, 1-7, 1-6, 1-5, 1-4, 1-3, 1-2, or 1 day after administration with a CD3 multispecific antibody described herein, indicate that the subject is at low risk of developing severe CRS.

In embodiments, a CRP level of 6 mg/dL or greater (e.g., 6, 6.8, 7, 8, 9, 10, 11, 12, 13, 14, 15, 16, 17, 18, 19, 20, 22, 24, 26, 28, 30, 32, 34, 36, 38, 40 mg/dL or greater), e.g., when measured within 1-10 days (e.g., within 1-10, 1-9, 1-8, 1-7, 1-6, 1-5, 1-4, 1-3, 1-2, or 1 day after administration with a CD3 multispecific antibody described herein, indicate that the subject is at high risk of developing severe CRS.

In certain aspects, the disclosure provides a method of monitoring CRS (e.g., monitoring a patient having CRS0, CRS1, CSR2, or CRS3) or monitoring for the development of severe CRS, comprising evaluating one or more CRS biomarkers herein. The method can involve measuring the one or more biomarkers at a plurality of timepoints, e.g., at 2, 3, 4, 5, 6, 7, 8, 9, 10, or more timepoints. In certain aspects, the disclosure provides a method of managing CRS, comprising evaluating a subject at risk for developing CRS (e.g., severe CRS), and optionally administering a treatment for CRS, e.g., a treatment described herein.

Identifying a Subject Having CRS

In certain embodiments, the methods provided herein include the treatment of a subject who has CRS. In some embodiments, in some embodiments, the methods provided herein include a step of determining whether a subject has CRS (e.g., severe CRS). The method includes acquiring a CRS risk status, e.g., in response to an cancer immunotherapy, e.g., a CD3 multispecific antibody, for the subject, wherein said CRS risk status includes a measure of one or more of the level or activity of one or more (e.g., 3, 4, 5, 10, 15, 20, or more) cytokines chosen from sTNFR2, IP10, sIL1R2, sTNFR1, MIG, VEGF, sIL1R1, TNFα, IFNα, GCSF, sRAGE, IL1, IL2, IL4, IL5, IL10, IL12, IL13, IL18, IL1R1, IFNγ, IL6, IL8, sIL2Rα, sgp130, sIL6R, MCP1, MIP1α, MIP1 (3, FLT-3L, fractalkine, and GM-CSF, or laboratory tests (e.g., analytes) chosen from C-reactive protein (CRP), ferritin, lactate dehydrogenase (LDH), aspartate aminotransferase (AST), blood urea nitrogen (BUN), alanine aminotransferase (ALT), creatinine (Cr), fibrinogen, Prothrombin Time (PT), Partial Thromboplastin Time (PTT), or a combination thereof, in a sample (e.g., a blood sample).

In some embodiments, a ferritin level of at least about 23,500, 25,000, 30,000, 40,000, 50,000, 70,000, 80,000, 90,000, 100,000, 150,000, 200,000, or 250,000 ng/ml, and optionally up to about 299,000 or 412,000 ng/ml, is indicative of CRS (e.g., severe CRS). In some embodiments, a ferritin level of less than about 23,500, 20,000, 18,000, 16,000, 14,000, 12,000, 10,000, 9,000, 8,000, 7,000, 6,000 5,000, 4,000, 3,000, 2,000, or 1,000 ng/ml and optionally greater than about 280 ng/ml, is indicative that the subject does not have CRS (e.g., severe CRS).

In some embodiments, a LDH level of at least about 1,700, 2,000, 3,000, 4,000, 5,000, 6,000, 7,000, 8,000, 9,000, 10,000, 15,000, or 20,000 U/L, and optionally up to about 24,000 U/L, is indicative of CRS (e.g., severe CRS). In some embodiments, a LDH level of less than about 1,700, 1,500, 1,400, 1,300, 1,200, 1,100, 1,000, 900, 800, 700, 600, 500, 400, 300, or 200 U/L, and optionally greater than about 159 U/L, is indicative that the subject does not have CRS (e.g., severe CRS).

In some embodiments, a CRP level of at least about 20, 21, 22, 23, 24, 25, 26, 27, 28, 29, 30, 31, 32, 33, 34, or 35 mg/dl, and optionally up to about 38 mg/dl, is indicative of CRS (severe CRS). In some embodiments, a CRP level of less than about 20, 19, 18, 17, 16, 15, 14, 13, 12, 11, 10, 9, 8, 7, 6, 5, 4, 3, 2, or 1 mg/dl, and optionally greater than about 0.7 mg/dl, is indicative that the subject does not have CRS (e.g., severe CRS).

In some embodiments, an ALT level of at least about 100, 110, 120, 130, 140, 150, 160, 170, 180, 190, 200, 250, 300, 350, 400, 450, 500, 550, 600, 650, 700, 750, 800, 980, 900, 950, or 1000 U/L, and optionally up to 1300 U/L, is indicative of CRS (e.g., severe CRS). In some embodiments, an ALT level of less than about 100, 90, 80, 70, 60, 50, 40, or 30 U/L, and optionally greater than about 25 U/L, is indicative that the subject does not have CRS (e.g., severe CRS).

In some embodiments, an AST level of at least about 150, 200, 250, 300, 350, 400, 450, 500, 550, 600, 650, 700, 750, 800, 980, 900, 950, 1000 U/L, and optionally up to about 1500 U/L, is indicative of CRS (e.g., severe CRS). In some embodiments, an AST level of less than about 150, 140, 130, 120, 100, 90, 80, 70, 60, 50, 40, or 30 U/L, and optionally greater than about 15 U/L, is indicative that the subject does not have CRS (e.g., severe CRS).

In some embodiments, a BUN level of at least about 18, 19, 20, 25, 30, 35, 40, 45, 50, 60, 70, 80, 90, 100, 110, 120, 130, 140, 150, 160, 170, 180, or 190 mg/dl, and optionally up to about 210 mg/dl, is indicative of CRS (e.g., severe CRS). In some embodiments, a BUN level of less than about 18, 17, 16, 15, 14, 13, 12, 11, or 10 mg/dl, and optionally greater than about 5 mg/dl, is indicative that the subject does not have CRS (e.g., severe CRS).

In some embodiments, a fibrinogen level of less than about 150, 140, 130, 120, 110, 100, 90, 80, 70, 60, 50, 40, or 30 mg/dl, and optionally greater than about 20 mg/dl, is indicative of CRS (e.g., severe CRS). In some embodiments, a fibrinogen level of at least about 150, 160, 170, 180, 190, 200, or 210 mg/dl, and optionally up to about 230 mg/dl, is indicative that the subject does not have CRS (e.g., severe CRS).

In some embodiments, a PT level of at least about 17, 18, 19, 20, 21, or 22 sec, and optionally up to about 24 sec, is indicative of CRS (e.g., severe CRS). In some embodiments, a PT level of less than about 17, 16, 15, or 14 sec, and optionally greater than about 12 sec, is indicative that the subject does not have CRS (e.g., severe CRS).

In some embodiments, a PTT level of at least about 44, 45, 46, 47, 48, 49, 50, 51, 52, 53, 54, 55, 60, 65, 70, 75, 80, or 85 sec, and optionally up to about 95 sec, indicative of CRS (e.g., severe CRS). In some embodiments, a PTT level of less than about 44, 43, 42, 41, 40, 39, 38, 37, 36, 35, 34, 33, 32, 31, 30, 29, 28, or 27 sec, and optionally greater than about 25 sec, is indicative that the subject does not have CRS (e.g., severe CRS).

In some embodiments, a patient with severe CRS has an IFN-γ>75 pg/ml and IL-10>60 pg/ml. In some embodiments, a patient with severe CRS has an IFN-γ of greater than or equal to 40, 50, 60, 70, or 75 pg/ml, an IL-10 level of greater than or equal to 30, 40, 50, or 60 pg/ml, or any combination thereof.

Additional biomarkers for evaluating a subject for having CRS or at risk of CRS are disclosed in U.S. Patent Application Publication Nos. 2019/0336504 and 2018/0252727, each of which is incorporated by reference herein in its entirety.

Therapeutic Antibodies
General

In certain aspects, the methods and compositions provided herein relate to the use of therapeutic antibodies (e.g., antagonistic anti-CD40 antibodies and/or bispecific CD3-binding antibodies).

As set forth above, as used herein, the term "antibody" encompasses both full antibody molecules and antigen-binding fragments of full antibody molecules. Non-limiting examples of antigen-binding fragments include: (i) Fab fragments; (ii) F(ab')2 fragments; (iii) Fd fragments; (iv) Fv fragments; (v) single-chain Fv (scFv) molecules; (vi) dAb fragments; and (vii) minimal recognition units consisting of the amino acid residues that mimic the hypervariable region of an antibody (e.g., an isolated complementarity determining region (CDR) such as a CDR3 peptide), or a constrained FR3-CDR3-FR4 peptide. Other engineered molecules, such as domain-specific antibodies, single domain antibodies, domain-deleted antibodies, chimeric antibodies, CDR-grafted antibodies, diabodies, triabodies, tetrabodies, minibodies, nanobodies (e.g. monovalent nanobodies, bivalent nanobodies, etc.), small modular immunopharmaceuticals (SMIPs), and shark variable IgNAR domains, are also encompassed within the expression "antigen-binding fragment," as used herein.

An antigen-binding fragment of an antibody will typically comprise at least one variable domain. The variable domain may be of any size or amino acid composition and will generally comprise at least one CDR which is adjacent to or in frame with one or more framework sequences. In antigen-binding fragments having a $V_H$ domain associated with a $V_L$ domain, the $V_H$ and $V_L$ domains may be situated relative to one another in any suitable arrangement. For example, the variable region may be dimeric and contain $V_H$-$V_H$, $V_H$-$V_L$ or $V_L$-$V_L$ dimers. Alternatively, the antigen-binding fragment of an antibody may contain a monomeric $V_H$ or $V_L$ domain.

In certain embodiments, an antigen-binding fragment of an antibody may contain at least one variable domain covalently linked to at least one constant domain. Non-limiting, exemplary configurations of variable and constant domains that may be found within an antigen-binding fragment of an antibody of the present invention include: (i) $V_H$-$C_H1$; (ii) $V_H$-$C_H2$; (iii) $V_H$-$C_H3$; (iv) $V_H$-$C_H1$-$C_H2$; (v) $V_H$-$C_H1$-$C_H2$-$C_H3$; (vi) $V_H$-$C_H2$-$C_H3$; (vii) $V_H$-CL; (viii) $V_L$-$C_H1$; (ix) $V_L$-$C_H2$; (x) $V_L$-$C_H3$; (xi) $V_L$-$C_H1$-$CH_2$; (xii) $V_L$-$C_H1$-$C_H2$-$C_H3$; (xiii) $V_L$-$C_H2$-$C_H3$; and (xiv) $V_L$-CL. In any configuration of variable and constant domains, including any of the exemplary configurations listed above, the variable and constant domains may be either directly linked to one another or may be linked by a full or partial hinge or linker region. A hinge region may consist of at least 2 (e.g., 5, 10, 15, 20, 40, 60 or more) amino acids which result in a flexible or semi-flexible linkage between adjacent variable and/or constant domains in a single polypeptide molecule. Moreover, an antigen-binding fragment of an antibody of the present invention may comprise a homo-dimer or hetero-dimer (or other multimer) of any of the variable and constant domain configurations listed above in non-covalent association with one another and/or with one or more monomeric $V_H$ or $V_L$ domain (e.g., by disulfide bond(s)).

As with full antibody molecules, antigen-binding fragments may be monospecific or multispecific (e.g., bispecific). A multispecific antigen-binding fragment of an antibody will typically comprise at least two different variable domains, wherein each variable domain is capable of specifically binding to a separate antigen or to a different epitope on the same antigen. Any multispecific antibody format, including the exemplary bispecific antibody formats disclosed herein, may be adapted for use in the context of an antigen-binding fragment of an antibody of the present invention using routine techniques available in the art. In certain embodiments provided herein, at least one variable domain of a multispecific antibody is capable of specifically binding to CD3.

In some embodiments, the antibodies provided herein may function through complement-dependent cytotoxicity (CDC) or antibody-dependent cell-mediated cytotoxicity (ADCC). "Complement-dependent cytotoxicity" (CDC) refers to lysis of antigen-expressing cells by an antibody of the invention in the presence of complement. "Antibody-dependent cell-mediated cytotoxicity" (ADCC) refers to a cell-mediated reaction in which nonspecific cytotoxic cells that express Fc receptors (FcRs) (e.g., Natural Killer (NK) cells, neutrophils, and macrophages) recognize bound antibody on a target cell and thereby lead to lysis of the target cell. CDC and ADCC can be measured using assays that are well known and available in the art. (See, e.g., U.S. Pat. Nos. 5,500,362 and 5,821,337, and Clynes et al. (1998) Proc. Natl. Acad. Sci. (USA) 95:652-656). The constant region of an antibody is important in the ability of an antibody to fix complement and mediate cell-dependent cytotoxicity. Thus, the isotype of an antibody may be selected on the basis of whether it is desirable for the antibody to mediate cytotoxicity.

In certain embodiments provided herein, the anti-CD40 antagonist antibodies or CD3 multispecific (e.g., bispecific or trispecific) antibodies provided herein are human antibodies. The term "human antibody," as used herein, is intended to include antibodies having variable and constant regions derived from human germline immunoglobulin sequences. The human antibodies of the invention may include amino acid residues not encoded by human germline immunoglobulin sequences (e.g., mutations introduced by random or site-specific mutagenesis in vitro or by somatic mutation in vivo), for example in the CDRs and in particular CDR3. However, the term "human antibody", as used herein, is not intended to include antibodies in which CDR sequences derived from the germline of another mammalian species, such as a mouse, have been grafted onto human framework sequences.

The antibodies provided herein, in some embodiments, may be recombinant human antibodies. The term "recombinant human antibody," as used herein, is intended to include all human antibodies that are prepared, expressed, created or isolated by recombinant means, such as antibodies expressed using a recombinant expression vector transfected into a host cell (described further below), antibodies isolated from a recombinant, combinatorial human antibody library (described further below), antibodies isolated from an animal (e.g., a mouse) that is transgenic for human immunoglobulin genes (see e.g., Taylor et al. (1992) Nucl. Acids Res. 20:6287-6295) or antibodies prepared, expressed, created or isolated by any other means that involves splicing of human immunoglobulin gene sequences to other DNA sequences. Such recombinant human antibodies have variable and constant regions derived from human germline immunoglobulin sequences. In certain embodiments, however, such recombinant human antibodies are subjected to in vitro mutagenesis (or, when an animal transgenic for human Ig sequences is used, in vivo somatic mutagenesis) and thus the amino acid sequences of the $V_H$ and $V_L$ regions of the recombinant antibodies are sequences that, while derived from and related to human germline $V_H$ and $V_L$ sequences, may not naturally exist within the human antibody germline repertoire in vivo.

Human antibodies can exist in two forms that are associated with hinge heterogeneity. In one form, an immunoglobulin molecule comprises a stable four chain construct of approximately 150-160 kDa in which the dimers are held together by an interchain heavy chain disulfide bond. In a second form, the dimers are not linked via inter-chain disulfide bonds and a molecule of about 75-80 kDa is formed composed of a covalently coupled light and heavy chain (half-antibody). These forms have been extremely difficult to separate, even after affinity purification.

The frequency of appearance of the second form in various intact IgG isotypes is due to, but not limited to, structural differences associated with the hinge region isotype of the antibody. A single amino acid substitution in the hinge region of the human IgG4 hinge can significantly reduce the appearance of the second form (Angal et al. (1993) *Molecular Immunology* 30:105) to levels typically observed using a human IgG1 hinge. The instant invention encompasses antibodies having one or more mutations in the hinge, $C_H2$ or $C_H3$ region which may be desirable, for example, in production, to improve the yield of the desired antibody form.

The antibodies of the invention may be isolated antibodies. An "isolated antibody," as used herein, means an antibody that has been identified and separated and/or recovered from at least one component of its natural environment. For example, an antibody that has been separated or removed from at least one component of an organism, or from a tissue or cell in which the antibody naturally exists or is naturally produced, is an "isolated antibody" for purposes of the present invention. An isolated antibody also includes an antibody in situ within a recombinant cell. Isolated antibodies are antibodies that have been subjected to at least one purification or isolation step. According to certain embodiments, an isolated antibody may be substantially free of other cellular material and/or chemicals.

In certain embodiments, the methods and compositions provided herein include one-arm antibodies that bind CD40. As used herein, a "one-arm antibody" means an antigen-binding molecule comprising a single antibody heavy chain and a single antibody light chain.

Sequence Variants

In some embodiments, the anti-CD40 antagonist antibodies and/or CD3 multispecific (e.g., bispecific or trispecific) antibodies disclosed herein may comprise one or more amino acid substitutions, insertions and/or deletions in the framework and/or CDR regions of the heavy and light chain variable domains as compared to the corresponding germline sequences from which the antibodies were derived. Such mutations can be readily ascertained by comparing the amino acid sequences disclosed herein to germline sequences available from, for example, public antibody sequence databases. The present invention includes antibodies, and antigen-binding fragments thereof, which are derived from any of the amino acid sequences disclosed herein, wherein one or more amino acids within one or more framework and/or CDR regions are mutated to the corresponding residue(s) of the germline sequence from which the antibody was derived, or to the corresponding residue(s) of another human germline sequence, or to a conservative amino acid substitution of the corresponding germline residue(s) (such sequence changes are referred to herein collectively as "germline mutations"). A person of ordinary skill in the art, starting with the heavy and light chain variable region sequences disclosed herein, can easily produce numerous antibodies and antigen-binding fragments which comprise one or more individual germline mutations or combinations thereof. In certain embodiments, all of the framework and/or CDR residues within the $V_H$ and/or $V_L$ domains are mutated back to the residues found in the original germline sequence from which the antibody was derived. In other embodiments, only certain residues are mutated back to the original germline sequence, e.g., only the mutated residues found within the first 8 amino acids of FR1 or within the last 8 amino acids of FR4, or only the mutated residues found within CDR1, CDR2 or CDR3. In other embodiments, one or more of the framework and/or CDR residue(s) are mutated to the corresponding residue(s) of a different germline sequence (i.e., a germline sequence that is different from the germline sequence from which the antibody was originally derived). Furthermore, the antibodies of the present invention may contain any combination of two or more germline mutations within the framework and/or CDR regions, e.g., wherein certain individual residues are mutated to the corresponding residue of a particular germline sequence while certain other residues that differ from the original germline sequence are maintained or are mutated to the corresponding residue of a different germline sequence. Once obtained, antibodies and antigen-binding fragments that contain one or more germline mutations can be easily tested for one or more desired property such as, improved binding specificity, increased binding (e.g., as measured by cell binding titration or FACS binding) or binding affinity (e.g., $K_D$), improved or enhanced antagonistic or agonistic biological properties (as the case may be), reduced immunogenicity, etc. Antibodies and antigen-binding fragments obtained in this general manner are encompassed within the present invention.

In some embodiments, the anti-CD40 antagonist antibodies or CD3 multispecific (e.g., bispecific or trispecific) antibodies provided herein comprise variants of any of the HCVR, LCVR, and/or CDR amino acid sequences disclosed herein having one or more conservative substitutions. For example, in certain embodiments the anti-CD40 antagonist antibodies or CD3 multispecific (e.g., bispecific or trispecific) antibodies provided herein have HCVR, LCVR, and/or CDR amino acid sequences with, e.g., 10 or fewer, 8 or fewer, 6 or fewer, 4 or fewer, etc. conservative amino acid substitutions relative to any of the HCVR, LCVR, and/or CDR amino acid sequences disclosed herein.

Fc Variants

According to certain embodiments provided herein, antibodies and multispecific antigen-binding molecules are provided comprising an Fc domain comprising one or more mutations which enhance or diminish antibody binding to the FcRn receptor, e.g., at acidic pH as compared to neutral pH. For example, the present invention includes antibodies comprising a mutation in the $C_H2$ or a $C_H3$ region of the Fc domain, wherein the mutation(s) increases the affinity of the Fc domain to FcRn in an acidic environment (e.g., in an endosome where pH ranges from about 5.5 to about 6.0). Such mutations may result in an increase in serum half-life of the antibody when administered to an animal. Non-limiting examples of such Fc modifications include, e.g., a modification at position 250 (e.g., E or Q); 250 and 428 (e.g., L or F); 252 (e.g., L/Y/F/W or T), 254 (e.g., S or T), and 256 (e.g., S/R/Q/E/D or T); or a modification at position 428 and/or 433 (e.g., H/L/R/S/P/Q or K) and/or 434 (e.g., H/F or Y); or a modification at position 250 and/or 428; or a modification at position 307 or 308 (e.g., 308F, V308F), and 434. In one embodiment, the modification comprises a 428L (e.g., M428L) and 434S (e.g., N434S) modification; a 428L, 259I (e.g., V259I), and 308F (e.g., V308F) modification; a 433K (e.g., H433K) and a 434 (e.g., 434Y) modification; a 252, 254, and 256 (e.g., 252Y, 254T, and 256E) modification; a 250Q and 428L modification (e.g., T250Q and M428L); and a 307 and/or 308 modification (e.g., 308F or 308P).

For example, the present invention includes CD3 multispecific antigen-binding molecules (e.g., anti-CD3/anti-MUC16 bispecific, anti-BCMAxanti-CD3, or anti-CD3/anti-CD20 bispecific antibodies), comprising an Fc domain comprising one or more pairs or groups of mutations selected from the group consisting of: 250Q and 248L (e.g., T250Q and M248L); 252Y, 254T and 256E (e.g., M252Y, S254T and T256E); 428L and 434S (e.g., M428L and N434S); and 433K and 434F (e.g., H433K and N434F). All possible combinations of the foregoing Fc domain mutations, and other mutations within the antibody variable domains disclosed herein, are contemplated within the scope of the present invention.

Bioequivalents

Provided herein antigen-binding molecules having amino acid sequences that vary from those of the exemplary molecules disclosed herein but that retain the ability to bind the same antigen or antigens. Such variant molecules may comprise one or more additions, deletions, or substitutions of amino acids when compared to parent sequence, but exhibit biological activity that is essentially equivalent to that of the described bispecific antigen-binding molecules.

The present invention includes antigen-binding molecules that are bioequivalent to any of the exemplary antigen-binding molecules set forth herein. Two antigen-binding proteins, or antibodies, are considered bioequivalent if, for example, they are pharmaceutical equivalents or pharmaceutical alternatives whose rate and extent of absorption do not show a significant difference when administered at the same molar dose under similar experimental conditions, either single does or multiple dose. Some antigen-binding proteins will be considered equivalents or pharmaceutical alternatives if they are equivalent in the extent of their absorption but not in their rate of absorption and yet may be considered bioequivalent because such differences in the rate of absorption are intentional and are reflected in the labeling, are not essential to the attainment of effective body drug concentrations on, e.g., chronic use, and are considered medically insignificant for the particular drug product studied.

In one embodiment, two antigen-binding proteins are bioequivalent if there are no clinically meaningful differences in their safety, purity, and potency.

In one embodiment, two antigen-binding proteins are bioequivalent if a patient can be switched one or more times between the reference product and the biological product without an expected increase in the risk of adverse effects, including a clinically significant change in immunogenicity, or diminished effectiveness, as compared to continued therapy without such switching.

In one embodiment, two antigen-binding proteins are bioequivalent if they both act by a common mechanism or mechanisms of action for the condition or conditions of use, to the extent that such mechanisms are known.

Bioequivalence may be demonstrated by in vivo and in vitro methods. Bioequivalence measures include, e.g., (a) an in vivo test in humans or other mammals, in which the concentration of the antibody or its metabolites is measured in blood, plasma, serum, or other biological fluid as a function of time; (b) an in vitro test that has been correlated with and is reasonably predictive of human in vivo bioavailability data; (c) an in vivo test in humans or other mammals in which the appropriate acute pharmacological effect of the antibody (or its target) is measured as a function of time; and (d) in a well-controlled clinical trial that establishes safety, efficacy, or bioavailability or bioequivalence of an antigen-binding protein.

Bioequivalent variants of the exemplary bispecific antigen-binding molecules set forth herein may be constructed by, for example, making various substitutions of residues or sequences or deleting terminal or internal residues or sequences not needed for biological activity. For example, cysteine residues not essential for biological activity can be deleted or replaced with other amino acids to prevent formation of unnecessary or incorrect intramolecular disulfide bridges upon renaturation. In other contexts, bioequivalent antigen-binding proteins may include variants of the exemplary bispecific antigen-binding molecules set forth herein comprising amino acid changes which modify the glycosylation characteristics of the molecules, e.g., mutations which eliminate or remove glycosylation.

Antibody Binding

As used herein, the term "binding" in the context of the binding of an antibody, immunoglobulin, antibody-binding fragment, or Fc-containing protein to either, e.g., a predetermined antigen, such as a cell surface protein or fragment thereof, typically refers to an interaction or association between a minimum of two entities or molecular structures, such as an antibody-antigen interaction.

For instance, binding affinity typically corresponds to a $K_D$ value of about $10^{-7}$ M or less, such as about $10^{-8}$ M or less, such as about $10^{-9}$ M or less when determined by, for instance, surface plasmon resonance (SPR) technology in a BIAcore 3000 instrument using the antigen as the ligand and the antibody, Ig, antibody-binding fragment, or Fc-containing protein as the analyte (or antiligand). Cell-based binding strategies, such as fluorescent-activated cell sorting (FACS) binding assays, are also routinely used, and FACS data correlates well with other methods such as radioligand competition binding and SPR (Benedict, C A, *J Immunol Methods*. 1997, 201(2):223-31; Geuijen, C A, et al. *J Immunol Methods*. 2005, 302(1-2):68-77).

Accordingly, the antibody or antigen-binding protein provided herein binds to the predetermined antigen or cell surface molecule (receptor) having an affinity corresponding to a $K_D$ value that is at least ten-fold lower than its affinity for binding to a non-specific antigen (e.g., BSA, casein). According to the present invention, the affinity of an antibody corresponding to a $K_D$ value that is equal to or less than ten-fold lower than a non-specific antigen may be considered non-detectable binding, however such an antibody may be paired with a second antigen binding arm for the production of a bispecific antibody of the invention.

The term "$K_D$" (M) refers to the dissociation equilibrium constant of a particular antibody-antigen interaction, or the dissociation equilibrium constant of an antibody or antibody-binding fragment binding to an antigen. There is an inverse relationship between $K_D$ and binding affinity, therefore the smaller the $K_D$ value, the higher, i.e. stronger, the affinity. Thus, the terms "higher affinity" or "stronger affinity" relate to a higher ability to form an interaction and therefore a smaller $K_D$ value, and conversely the terms "lower affinity" or "weaker affinity" relate to a lower ability to form an interaction and therefore a larger $K_D$ value. In some circumstances, a higher binding affinity (or $K_D$) of a particular molecule (e.g. antibody) to its interactive partner molecule (e.g. antigen X) compared to the binding affinity of the molecule (e.g. antibody) to another interactive partner molecule (e.g. antigen Y) may be expressed as a binding ratio determined by dividing the larger $K_D$ value (lower, or weaker, affinity) by the smaller $K_D$ (higher, or stronger, affinity), for example expressed as 5-fold or 10-fold greater binding affinity, as the case may be.

The term "$k_d$" (sec−1 or 1/s) refers to the dissociation rate constant of a particular antibody-antigen interaction, or the dissociation rate constant of an antibody or antibody-binding fragment. Said value is also referred to as the $k_{off}$ value.

The term "$k_a$" (M−1×sec−1 or 1/M) refers to the association rate constant of a particular antibody-antigen interaction, or the association rate constant of an antibody or antibody-binding fragment.

The term "$K_A$" (M−1 or 1/M) refers to the association equilibrium constant of a particular antibody-antigen interaction, or the association equilibrium constant of an antibody or antibody-binding fragment. The association equilibrium constant is obtained by dividing the $k_a$ by the $k_d$.

The term "EC50" or "$EC_{50}$" refers to the half maximal effective concentration, which includes the concentration of an antibody which induces a response halfway between the baseline and maximum after a specified exposure time. The $EC_{50}$ essentially represents the concentration of an antibody where 50% of its maximal effect is observed. In certain embodiments, the $EC_{50}$ value equals the concentration of an antibody of the invention that gives half-maximal binding to cells expressing CD3 or tumor-associated antigen (e.g., CD123, STEAP2, CD20, PSMA, SSTR2, CD38, STEAP1, 5T4, ENPP3, MUC16, or BCMA), as determined by e.g. a FACS binding assay. Thus, reduced or weaker binding is observed with an increased $EC_{50}$, or half maximal effective concentration value.

In one embodiment, decreased binding of CD3 multispecific antibodies can be defined as an increased $EC_{50}$ antibody concentration which enables binding to the half-maximal amount of target cells.

In another embodiment, the $EC_{50}$ value represents the concentration of a CD3 multispecific antibody of the invention that elicits half-maximal depletion of target cells by T cell cytotoxic activity. Thus, increased cytotoxic activity (e.g. T cell-mediated tumor cell killing) is observed with a decreased $EC_{50}$, or half maximal effective concentration value.

pH-Dependent Binding

In some embodiments, the present invention includes antibodies and multispecific antigen-binding molecules with pH-dependent binding characteristics. For example, a CD3 multispecific antibody of the present invention may exhibit reduced binding to CD3 at acidic pH as compared to neutral pH. Alternatively, CD3 multispecific antibodies of the invention may exhibit enhanced binding to CD3 at acidic pH as compared to neutral pH. The expression "acidic pH" includes pH values less than about 6.2, e.g., about 6.0, 5.95, 5.9, 5.85, 5.8, 5.75, 5.7, 5.65, 5.6, 5.55, 5.5, 5.45, 5.4, 5.35, 5.3, 5.25, 5.2, 5.15, 5.1, 5.05, 5.0, or less. As used herein, the expression "neutral pH" means a pH of about 7.0 to about 7.4. The expression "neutral pH" includes pH values of about 7.0, 7.05, 7.1, 7.15, 7.2, 7.25, 7.3, 7.35, and 7.4.

In certain instances, "reduced binding . . . at acidic pH as compared to neutral pH" is expressed in terms of a ratio of the $K_D$ value of the antibody binding to its antigen at acidic pH to the $K_D$ value of the antibody binding to its antigen at neutral pH (or vice versa). For example, a CD3 multispecific antibody or antigen-binding fragment thereof may be regarded as exhibiting "reduced binding to CD3 at acidic pH as compared to neutral pH" for purposes of the present invention if the CD3 multispecific antibody or antigen-binding fragment thereof exhibits an acidic/neutral $K_D$ ratio of about 3.0 or greater. In certain exemplary embodiments, the acidic/neutral $K_D$ ratio for an antibody or antigen-binding fragment of the present invention can be about 3.0, 3.5, 4.0, 4.5, 5.0, 5.5, 6.0, 6.5, 7.0, 7.5, 8.0, 8.5, 9.0, 9.5, 10.0, 10.5, 11.0, 11.5, 12.0, 12.5, 13.0, 13.5, 14.0, 14.5, 15.0, 20.0. 25.0, 30.0, 40.0, 50.0, 60.0, 70.0, 100.0 or greater.

Antibodies with pH-dependent binding characteristics may be obtained, e.g., by screening a population of antibodies for reduced (or enhanced) binding to a particular antigen at acidic pH as compared to neutral pH. Additionally, modifications of the antigen-binding domain at the amino acid level may yield antibodies with pH-dependent characteristics. For example, by substituting one or more amino acids of an antigen-binding domain (e.g., within a CDR) with a histidine residue, an antibody with reduced antigen-binding at acidic pH relative to neutral pH may be obtained.

Preparation of Antigen-Binding Domains and Construction of Multispecific Molecules Antigen-binding domains specific for particular antigens can be prepared by any antibody generating technology known in the art. Once obtained, two different antigen-binding domains, specific for two different antigens (e.g., CD3 and a human tumor antigen (e.g., MUC16, BCMA, CD20, etc.)), can be appropriately arranged relative to one another to produce a bispecific antigen-binding molecule of the present invention using routine methods. In certain embodiments, one or more of the individual components (e.g., heavy and light chains) of the multispecific antigen-binding molecules of the invention are derived from chimeric, humanized or fully human antibodies. Methods for making such antibodies are well known in the art. For example, one or more of the heavy and/or light chains of the bispecific antigen-binding molecules of the present invention can be prepared using VELOCIMMUNE™ technology. Using VELOCIMMUNE™ technology (or any other human antibody generating technology), high affinity chimeric antibodies to a particular antigen (e.g., CD3 or human tumor antigen (e.g., MUC16, BCMA, CD20, etc.)) are initially isolated having a human variable region and a mouse constant region. The antibodies are characterized and selected for desirable characteristics, including affinity, selectivity, epitope, etc. The mouse constant regions are replaced with a desired human constant region to generate fully human heavy and/or light chains that can be incorporated into the bispecific antigen-binding molecules of the present invention.

Genetically engineered animals may be used to make human bispecific antigen-binding molecules. For example, a genetically modified mouse can be used which is incapable of rearranging and expressing an endogenous mouse immunoglobulin light chain variable sequence, wherein the mouse expresses only one or two human light chain variable domains encoded by human immunoglobulin sequences operably linked to the mouse kappa constant gene at the endogenous mouse kappa locus. Such genetically modified mice can be used to produce fully human bispecific antigen-binding molecules comprising two different heavy chains that associate with an identical light chain that comprises a variable domain derived from one of two different human light chain variable region gene segments. (See, e.g., US 2011/0195454). Fully human refers to an antibody, or antigen-binding fragment or immunoglobulin domain thereof, comprising an amino acid sequence encoded by a DNA derived from a human sequence over the entire length of each polypeptide of the antibody or antigen-binding fragment or immunoglobulin domain thereof. In some instances, the fully human sequence is derived from a protein endogenous to a human. In other instances, the fully human protein or protein sequence comprises a chimeric sequence wherein each component sequence is derived from human sequence. While not being bound by any one theory, chimeric proteins or chimeric sequences are generally designed to minimize the creation of immunogenic epitopes in the junctions of component sequences, e.g. compared to any wild-type human immunoglobulin regions or domains.

CD40 Antagonists

In certain aspects, provided herein are methods of treating cancer and/or inhibiting cytokine release by administering to a subject (e.g., a subject in need thereof) a CD40 antagonist.

The term "CD40 antagonist" refers to any agent that inhibits or blocks a CD40-mediated effect. It may be a small molecule, an antibody, an antisense oligonucleotide, a siRNA, a shRNA, a sgRNA, a peptide, etc. In some embodiments, the CD40 antagonist is an antibody (e.g., an antigen binding antibody fragment) that binds to CD40. The "antagonistic" effect of the anti-CD40 antibody means the effect of inhibiting the binding of CD40 expressed in the surface of cells such as B cells, tumor cells, or dendritic cells with its ligands or the effect of neutralizing one or more of influences of CD40 ligands on CD40-expressing cells. An "antagonistic antibody" means an antibody that has such effects. One example of the influences on CD40-expressing cells includes the suppression of B cell growth or the suppression of antibody production.

In some embodiments, the CD40 antagonist antibody (e.g., an antigen binding antibody fragment) targets the CD40 receptor and interfere with CD40 signaling, particularly CD40 signaling pathways that are mediated by interaction of CD40 with the CD40 ligand (CD40L). The term "CD40 antigen," "CD40 cell surface antigen," "CD40 receptor," or "CD40" refers to a transmembrane glycoprotein that belongs to the tumor necrosis factor (TNF) receptor family (see, for example, U.S. Pat. Nos. 5,674,492 and 4,708,871; Stamenkovic et al. (1989) EMBO 8:1403; Clark (1990) Tissue Antigens 36:33; Barclay et al. (1997) The Leucocyte Antigen Facts Book (2d ed.; Academic Press, San Diego)). At least six isoforms of human CD40, encoded by alternatively spliced transcript variants of this gene, have been identified (NM_001250.6 and NP_001241.1; NM_001302753.2 and NP_001289682.1; NM_001322421.2 and NP_001309350.1; NM_001322422.2 and NP_001309351.1; NM_001362758.2 and NP_001349687.1; and NM_152854.4 and NP_690593.1). For purposes of the present invention, the term "CD40 antigen," "CD40 cell surface antigen," "CD40 receptor," or "CD40" encompasses all isoforms of CD40.

The CD40 antigen can be displayed on the surface of a variety of cell types, as described elsewhere herein. The term "displayed on the surface" and "expressed on the surface" refers to instances in which all or a portion of the CD40 antigen is exposed to the exterior of the cell. The displayed or expressed CD40 antigen may be fully or partially glycosylated.

By "antagonist activity" is intended that the substance functions as an antagonist. An antagonist of CD40 prevents or reduces induction of any of the responses induced by binding of the CD40 receptor to an agonist ligand, particularly CD40L. The antagonist may reduce induction of any one or more of the responses to agonist binding by 5%, 10%, 15%, 20%, 25%, 30%, 35%, preferably 40%, 45%, 50%, 55%, 60%, more preferably 70%, 80%, 85%, and most preferably 90%, 95%, 99%, or 100%. Methods for measuring CD40 ligand binding specificity and antagonist activity of an anti-CD40 therapeutic agent, for example, an anti-CD40 antibody, are known in the art and include, but are not limited to, standard competitive binding assays, assays for monitoring immunoglobulin secretion by B cells, B cell proliferation assays, Banchereau-Like-B cell proliferation assays, T cell helper assays for antibody production, co-stimulation of B cell proliferation assays, and assays for up-regulation of B cell activation markers. See, for example, such assays disclosed in WO 00/75348 and U.S. Pat. No. 6,087,329, herein incorporated by reference. Also see, provisional applications entitled "Antagonist Anti-CD40 Monoclonal Antibodies and Methods for Their Use," filed Nov. 4, 2003, Nov. 26, 2003, and Apr. 27, 2004, and assigned U.S. Patent Application Nos. 60/517,337, 60/525,579, and 60/565,710, respectively, and International Patent Application No. PCT/US2004/037152, also entitled "Antagonist Anti-CD40 Monoclonal Antibodies and Methods for Their Use," filed Nov. 4, 2004, and published as WO 2005/044854); the contents of each of which are herein incorporated by reference in their entirety.

Any of the assays known in the art can be used to determine whether an anti-CD40 antibody acts as an antagonist of one or more B cell responses. In some embodiments, the anti-CD40 antibody acts as an antagonist of at least one B cell response selected from the group consisting of B cell proliferation, B cell differentiation, antibody production, intercellular adhesion, B cell memory generation, isotype switching, up-regulation of cell-surface expression of MHC Class II and CD80/86, and secretion of pro-inflammatory cytokines such as IL-8, IL-12, and TNF. Of particular interest are antagonist anti-CD40 antibodies that free of significant agonist activity with respect to B cell proliferation when bound to the human CD40 antigen on the surface of a human B cell.

The term "CD40 ligand" includes any peptide, polypeptide, or protein that can bind to and activate one or more CD40 signaling pathways. Thus, "CD40 ligands" include, but are not limited to, full-length CD40 ligand proteins and variants and fragments thereof that retain sufficient activity to carry out the function of binding to and stimulating CD40 signaling on CD40-expressing cells. Modifications to a native CD40 ligand, for example, human CD40 ligand (CD40L; also known as CD154), include, but are not limited to, substitutions, deletions, truncations, extensions, fusion proteins, fragments, peptidomimetics, and the like. In some embodiments of the invention, an assay for assessing biological activity of an antagonist anti-CD40 antibody includes the use of soluble CD40L, for example, soluble recombinant human CD40L (Alexis Corporation, Bingham, Nottinghamshire, UK) to stimulate CD40 signaling on CD40-expressing cells.

"CD40L-mediated CD40 signaling" refers to any of the biological activities that result from interaction of the cell-surface receptor CD40 with a CD40 ligand. Examples of CD40 signaling are signals that lead to proliferation and survival of CD40-expressing cells, and stimulation of one or more CD40-signaling pathways within CD40-expressing cells. A CD40 "signaling pathway" or "signal transduction pathway" is intended to mean at least one biochemical reaction, or a group of biochemical reactions, that results from interaction of the CD40 receptor with a CD40 ligand, for example, CD40L, and which generates a signal that, when transmitted through the signal pathway, leads to activation of one or more downstream molecules in the signaling cascade. Signal transduction pathways involve a number of signal transduction molecules that lead to transmission of a signal from the cell-surface CD40 receptor across the plasma membrane of a cell, and through one or more in a series of signal transduction molecules, through the cytoplasm of the cell, and in some instances, into the cell's nucleus. CD40 signal transduction pathways include, for example, the AKT signaling pathway, which leads to activation of AKT, and ultimately activation of NF-κB via the NF-κB signaling pathway; and mitogen-activated protein kinase (MAPK) signaling pathways, including the MEK/ERK signaling pathway and the MEK/p38 signaling pathway, which lead to activation of ERK and p38, respectively. The balance between activation and blocking of these signaling pathways favors either cell survival or apoptosis.

In some embodiments, the CD40 antagonist antibody is a monoclonal antibody. In certain embodiments, the CD40 antagonist antibody or antigen-binding fragment thereof is chimeric, humanized, composite, murine, or human. In some embodiments, the CD40 antagonist antibody or antigen-binding fragment thereof is selected from Fv, Fav, F(ab')2, Fab', dsFv, scFv, sc(Fv)2, and diabodies fragments.

CD40 antagonist antibodies provided herein include but are not limited to, e.g., iscalimab (also known as CFZ533) disclosed in Kahaly et al. (2019) J. Endocr. Sco. 3:doi.org/10.1210/js.2019-0R19-6, Fisher et al. (2017) Arthritis Rheumatol. 69:1784, Farkash et al. (2019) Am. J. Transplant. 19:632, and International Patent Application Publication No. WO 2012/075111A1; ravagalimab (also known as ABBV-323) disclosed in International Patent Application Publication No. WO 2016/196314A1; BI 655064 disclosed in Visvannathan et al. (2016) Arthritis Rheumatol. 68:1588); bleselumab (also known as ASKP1240 or 341G2) disclosed in Anil et al. (2018) Biopharm. Drug Dispos. 39:245-255, Harland et al. (2017) Am. J. Transplant. 17:159-171, and U.S. Pat. No. 8,716,451B2; ch5D12 disclosed in Kasran et al. (2005) Aliment. Pharmacol. Ther. 22:111-122; lucatumumab (also known as HCD122 or CHIR-12.12) disclosed in Bensinger et al. (2012) British J. Haematology 159:58-66, Byrd et al. (2012) Leuk. Lymphoma 53:10.3109/10428194.2012.681655, and International Patent Application No. PCT/US2004/037152; CHIR-5.9 disclosed in International Patent Application No. PCT/US2004/037152; 201A3 disclosed in Perper et al. (2019) J. Immunol. 203: 58-75; KPL-404 disclosed in clinical trial NCT04497662 sponsored by Kiniksa Pharmaceuticals, Ltd.; PG102 disclosed in Bankert et al. (2015) J. Immunol. 194:4319-4327 and International Patent Application Publication No. WO 2001/024823A1; and BIIB063 disclosed in Musselli et al. (2017) 2017 ACR/ARHP Annual Meeting Abstract, the contents of each of which are herein incorporated by reference in their entirety.

Additional CD40 antagonist antibodies useful in certain embodiments of the methods and compositions provided herein are disclosed in, for example, International Patent Application Publication Nos. WO 02/11763A1, WO 02/28481A9, WO 03/045978A3, WO 03/029296A1, WO 03/028809A1, WO 2005/044854, WO 2006/073443A3, WO 2007/124299A8, WO 2011/123489A3, WO 2016/196, 314A1, WO 2017/040566A1, WO 2017/060242A1, WO 2018/217976A1, WO2019/156565A1, WO 2020/144605A1, WO 2020/106620A1, and WO 2020/006347A1, U.S. Patent Application Publication Nos. US 2020/0291123A1, US 2017/0158771A1, and US 2008/0057070A1, or U.S. Pat. No. 9,125,893B2, U.S. Pat. No. 8,669,352B2, and U.S. Pat. No. 9,598,494B2, the contents of each of which are herein incorporated by reference in their entirety.

The anti-CD40 antagonist antibodies disclosed herein may comprise one or more amino acid substitutions, insertions and/or deletions in the framework and/or CDR regions of the heavy and light chain variable domains as compared to the corresponding germline sequences from which the antibodies were derived. Such mutations can be readily ascertained by comparing the amino acid sequences disclosed herein to germline sequences available from, for example, public antibody sequence databases. The present invention includes antibodies, and antigen-binding fragments thereof, which are derived from any of the amino acid sequences disclosed herein, wherein one or more amino acids within one or more framework and/or CDR regions are mutated to the corresponding residue(s) of the germline sequence from which the antibody was derived, or to the corresponding residue(s) of another human germline sequence, or to a conservative amino acid substitution of the corresponding germline residue(s) (such sequence changes are referred to herein collectively as "germline mutations"). A person of ordinary skill in the art, starting with the heavy and light chain variable region sequences disclosed herein, can easily produce numerous antibodies and antigen-binding fragments which comprise one or more individual germline mutations or combinations thereof. In certain embodiments, all of the framework and/or CDR residues within the $V_H$ and/or $V_L$ domains are mutated back to the residues found in the original germline sequence from which the antibody was derived. In other embodiments, only certain residues are mutated back to the original germline sequence, e.g., only the mutated residues found within the first 8 amino acids of FR1 or within the last 8 amino acids of FR4, or only the mutated residues found within CDR1, CDR2 or CDR3. In other embodiments, one or more of the framework and/or CDR residue(s) are mutated to the corresponding residue(s) of a different germline sequence (i.e., a germline sequence that is different from the germline sequence from which the antibody was originally derived). Furthermore, the antibodies of the present invention may contain any combination of two or more germline mutations within the framework and/or CDR regions, e.g., wherein certain individual residues are mutated to the corresponding residue of a particular germline sequence while certain other residues that differ from the original germline sequence are maintained or are mutated to the corresponding residue of a different germline sequence. Once obtained, antibodies and antigen-binding fragments that contain one or more germline mutations can be easily tested for one or more desired property such as, improved binding specificity, increased binding (e.g., as measured by cell binding titration or FACS binding) or binding affinity (e.g., $K_D$), improved or enhanced antagonistic or agonistic biological properties (as the case may be), reduced immunogenicity, etc. Antibodies and antigen-binding fragments obtained in this general manner are encompassed within the present invention.

Provided herein are also anti-CD40 antagonist antibodies comprising variants of any of the HCVR, LCVR, and/or CDR amino acid sequences disclosed herein having one or more conservative substitutions. For example, the present invention includes anti-CD40 antagonist antibodies or CD3 multispecific (e.g., bispecific or trispecific) antibodies having HCVR, LCVR, and/or CDR amino acid sequences with, e.g., 10 or fewer, 8 or fewer, 6 or fewer, 4 or fewer, etc. conservative amino acid substitutions relative to any of the HCVR, LCVR, and/or CDR amino acid sequences disclosed herein.

CAR-T Cell Expressing CD40 Antagonist

In certain aspects, the methods and compositions provided herein relate to immune effector cells (e.g., CAR-T cell) that are engineered to express a CD40 Antagonist (e.g., a CD40 antagonist provided herein). In some embodiments, the CAR-T cell secretes the CD40 antagonist. In certain embodiments, the CD40 antagonist is a scFv or Fab. In some embodiments, the CAR-T cell expresses the CD40 antagonist when it is activated. Methods for generating CAR-T cell that secrete an antibody or an antigen binding fragment thereof are disclosed in, e.g., Choi et al. (2019) Nature Biotechnology 37:1049-1058, which is incorporate by reference herein in its entirety.

CAR-T cells are T cells that engineered to express a chimeric antigen receptor (CAR) polypeptide. CARs are receptors comprising a targeting moiety that is associated with one or more signaling domains and/or costimulatory domains in a single fusion molecule. In certain embodiments, the binding moiety of a CAR comprises an antigen-binding domain of a single-chain antibody (scFv), comprising the light and heavy chain variable fragments of a monoclonal antibody joined by a flexible linker. In certain embodiments, the binding moiety further comprises transmembrane and hinge domains of a monoclonal antibody. In certain embodiments, the binding domain and/or extracellular domain of a CAR provided herein provides the CAR with the ability to bind to the target antigen of interest (e.g., a tumor antigen).

A "signal transducing domain" or "signaling domain" of a CAR, as used herein, is responsible for intracellular signaling following the binding of an extracellular ligand binding domain to the target resulting in the activation of the immune cell and immune response. In other words, the signal transducing domain is responsible for the activation of at least one of the normal effector functions of the immune cell in which the CAR is expressed. For example, the effector function of a T cell can be a cytolytic activity or helper activity including the secretion of cytokines. Thus, the term "signal transducing domain" refers to the portion of a protein which transduces the effector function signal and directs the cell to perform a specialized function. Examples of signal transducing domains for use in a CAR can be the cytoplasmic sequences of the T cell receptor and co-receptors that act in concert to initiate signal transduction following antigen receptor engagement, as well as any derivate or variant of these sequences and any synthetic sequence that has the same functional capability. In some cases, signaling domains comprise two distinct classes of cytoplasmic signaling sequences, those that initiate antigen-dependent primary activation, and those that act in an antigen-independent manner to provide a secondary or co-stimulatory signal. Primary cytoplasmic signaling sequences can comprise signaling motifs which are known as immunoreceptor tyrosine-based activation motifs of ITAMs. ITAMs are well defined signaling motifs found in the intracytoplasmic tail of a variety of receptors that serve as binding sites for syk/zap70 class tyrosine kinases. Exemplary ITAMs include those derived from TCRζ, FcRγ, FcRβ, FcRε, CD3γ, CD3δ, CD3ε, CD5, CD22, CD79a, CD79b and CD66d.

In some embodiments, the cells are obtained from the subject to be treated (i.e., are autologous). However, in certain embodiments, immune effector cell lines or donor effector cells (allogeneic) are used.

Immune effector cells can be obtained from a number of sources, including peripheral blood mononuclear cells, bone marrow, lymph node tissue, cord blood, thymus tissue, tissue from a site of infection, ascites, pleural effusion, spleen tissue, and tumors. Immune effector cells can be obtained from blood collected from a subject using any number of techniques known to the skilled artisan, such as Ficoll™ separation. For example, cells from the circulating blood of an individual may be obtained by apheresis. In some embodiments, immune effector cells are isolated from peripheral blood lymphocytes by lysing the red blood cells and depleting the monocytes, for example, by centrifugation through a PERCOLL™ gradient or by counterflow centrifugal elutriation. A specific subpopulation of immune effector cells can be further isolated by positive or negative selection techniques. For example, immune effector cells can be isolated using a combination of antibodies directed to surface markers unique to the positively selected cells, e.g., by incubation with antibody-conjugated beads for a time period sufficient for positive selection of the desired immune effector cells. Alternatively, enrichment of immune effector cells population can be accomplished by negative selection using a combination of antibodies directed to surface markers unique to the negatively selected cells.

The present disclosure provides methods for making the immune effector cells which express the CARs and CD40 antagonists described herein. In one embodiment, the method comprises transfecting or transducing immune effector cells isolated from a subject, such as a subject having a PIG and/or low density cancer antigen expressing tumor cell, such that the immune effector cells express one or more CAR and CD40 antagonist as described herein. In certain embodiments, the immune effector cells are isolated from an individual and genetically modified without further manipulation in vitro. Such cells can then be directly re-administered into the individual. In further embodiments, the immune effector cells are first activated and stimulated to proliferate in vitro prior to being genetically modified to express a CAR and a CD40 antagonist. In this regard, the immune effector cells may be cultured before or after being genetically modified (i.e., transduced or transfected to express a CAR or a CD40 antagonist as described herein).

Prior to in vitro manipulation or genetic modification of the immune effector cells described herein, the source of cells may be obtained from a subject. In particular, the immune effector cells for use with the CARs and CD40 antagonists as described herein comprise T cells. T cells can be obtained from a number of sources, including peripheral blood mononuclear cells, bone marrow, lymph nodes tissue, cord blood, thymus issue, tissue from a site of infection, ascites, pleural effusion, spleen tissue, and tumors. In certain embodiments, T cell can be obtained from a unit of blood collected from the subject using any number of techniques known to the skilled person, such as FICOLL separation. In one embodiment, cells from the circulating blood of an individual are obtained by apheresis. The apheresis product typically contains lymphocytes, including T cells, monocytes, granulocyte, B cells, other nucleated white blood cells, red blood cells, and platelets. In one embodiment, the cells collected by apheresis may be washed to remove the plasma fraction and to place the cells in an appropriate buffer or media for subsequent processing. In one embodiment, the cells are washed with PBS. In an alternative embodiment, the washed solution lacks calcium, and may lack magnesium or may lack many, if not all, divalent cations. As would be appreciated by those of ordinary skill in the art, a washing step may be accomplished by methods known to those in the art, such as by using a semiautomated flowthrough centrifuge. After washing, the cells may be resuspended in a variety of biocompatible buffers or other saline solution with or without buffer. In certain embodiments, the undesirable components of the apheresis sample may be removed in the cell directly resuspended culture media.

In certain embodiments, T cells are isolated from peripheral blood mononuclear cells (PBMCs) by lysing the red blood cells and depleting the monocytes, for example, by centrifugation through a Ficoll-Paque™ gradient. A specific subpopulation of T cells, such as CD28+, CD4+, CD8+, CD45RA+, and CD45RO+ T cells, can be further isolated by positive or negative selection techniques. For example, enrichment of a T cell population by negative selection can be accomplished with a combination of antibodies directed to surface markers unique to the negatively selected cells. One method for use herein is cell sorting and/or selection via negative magnetic immunoadherence or flow cytometry that uses a cocktail of monoclonal antibodies directed to cell surface markers present on the cells negatively selected. For example, to enrich for CD4+ cells by negative selection, a monoclonal antibody cocktail typically includes antibodies to CD14, CD20, CD1 b, CD16, HLA-DR, and CD8. Flow cytometry and cell sorting may also be used to isolate cell populations of interest.

PBMCs may be used directly for genetic modification with the CARs and CD40 antagonists using methods as described herein. In certain embodiments, after isolation of PBMC, T lymphocytes are further isolated and in certain embodiments, both cytotoxic and helper T lymphocytes can be sorted into naive, memory, and effector T cell subpopulations either before or after genetic modification and/or expansion. CD8+ cells can be obtained by using standard methods. In some embodiments, CD8+ cells are further sorted into naive, central memory, and effector cells by identifying cell surface antigens that are associated with each of those types of CD8+ cells. In embodiments, memory T cells are present in both CD62L+ and CD62L-subsets of CD8+ peripheral blood lymphocytes. PBMC are sorted into CD62L-CD8+ and CD62L+CD8+ fractions after staining with anti-CD8 and anti-CD62L antibodies. In some embodiments, the expression of phenotypic markers of central memory TCM include CD45RO, CD62L, CCR7, CD28, CD3, and CD127 and are negative for granzyme B. In some embodiments, central memory T cells are CD45RO+, CD62L+, CD8+ T cells. In some embodiments, effector T cells are negative for CD62L, CCR7, CD28, and CD127, and positive for granzyme B and perforin. In some embodiments, naive CD8+T lymphocytes are characterized by the expression of phenotypic markers of naive T cells including CD62L, CCR7, CD28, CD3, CD 127, and CD45RA.

In certain embodiments, CD4+ T cells are further sorted into subpopulations. For example, CD4+T helper cells can be sorted into naive, central memory, and effector cells by identifying cell populations that have cell surface antigens. CD4+ lymphocytes can be obtained by standard methods. In some embodiments, naive CD4+T lymphocytes are CD45RO−, CD45RA+, CD62L+CD4+ T cell. In some embodiments, central memory CD4+ cells are CD62L positive and CD45RO positive. In some embodiments, effector CD4+ cells are CD62L and CD45RO negative.

The immune effector cells, such as T cells, can be genetically modified following isolation using known methods, or the immune effector cells can be activated and expanded (or differentiated in the case of progenitors) in vitro prior to being genetically modified. In another embodiment, the immune effector cells, such as T cells, are genetically modified with the chimeric antigen receptors described herein (e.g., transduced with a viral vector comprising a nucleic acid encoding a CAR or a CD40 antagonist) and then are activated and expanded in vitro. Methods for activating and expanding T cells are known in the art and are described, for example, in U.S. Pat. Nos. 6,905,874; 6,867,041; 6,797,514; WO2012079000. Generally, such methods include contacting PBMC or isolated T cells with a stimulatory agent and costimulatory agent, such as anti-CD3 and anti-CD28 antibodies, generally attached to a bead or other surface, in a culture medium with appropriate cytokines, such as IL-2 (e.g., recombinant human IL-2). Anti-CD3 and anti-CD28 antibodies attached to the same bead serve as a "surrogate" antigen presenting cell (APC). In other embodiments, the T cells may be activated and stimulated to proliferate with feeder cells and appropriate antibodies and cytokines using methods such as those described in U.S. Pat. Nos. 6,040,177; 5,827,642; and WO2012129514.

In some embodiments, the immune effector cells comprise any leukocyte involved in defending the body against infectious disease and foreign materials. For example, the immune effector cells can comprise lymphocytes, monocytes, macrophages, dendritic cells, mast cells, neutrophils, basophils, eosinophils, or any combinations thereof. For example, the immune effector cells can comprise T lymphocytes, preferably cytotoxic T lymphocytes (CTLs).

T helper cells ($T_H$ cells) assist other white blood cells in immunologic processes, including maturation of B cells into plasma cells and memory B cells, and activation of cytotoxic T cells and macrophages. These cells are also known as CD4+ T cells because they express the CD4 glycoprotein on their surface. Helper T cells become activated when they are presented with peptide antigens by MHC class II molecules, which are expressed on the surface of antigen-presenting cells (APCs). Once activated, they divide rapidly and secrete small proteins called cytokines that regulate or assist in the active immune response. These cells can differentiate into one of several subtypes, including $T_H1$, $T_H2$, $T_H3$, $T_H17$, $T_H9$, or $T_{FH}$, which secrete different cytokines to facilitate a different type of immune response.

Cytotoxic T cells (Tc cells, or CTLs) destroy virally infected cells and tumor cells, and are also implicated in transplant rejection. These cells are also known as $CD8^+$ T cells since they express the CD8 glycoprotein at their surface. These cells recognize their targets by binding to antigen associated with MHC class I molecules, which are present on the surface of all nucleated cells. Through IL-10, adenosine and other molecules secreted by regulatory T cells, the $CD8^+$ cells can be inactivated to an anergic state, which prevents autoimmune diseases.

Memory T cells are a subset of antigen-specific T cells that persist long-term after an infection has resolved. They quickly expand to large numbers of effector T cells upon re-exposure to their cognate antigen, thus providing the immune system with "memory" against past infections. Memory cells may be either $CD4^+$ or $CD8^+$. Memory T cells typically express the cell surface protein CD45RO.

Regulatory T cells ($T_{reg}$ cells), formerly known as suppressor T cells, are crucial for the maintenance of immunological tolerance. Their major role is to shut down T cell-mediated immunity toward the end of an immune reaction and to suppress auto-reactive T cells that escaped the process of negative selection in the thymus. Two major classes of $CD4^+$ $T_{reg}$ cells have been described—naturally occurring $T_{reg}$ cells and adaptive $T_{reg}$ cells.

Natural killer T (NKT) cells (not to be confused with natural killer (NK) cells) bridge the adaptive immune system with the innate immune system. Unlike conventional T cells that recognize peptide antigens presented by major histocompatibility complex (MHC) molecules, NKT cells recognize glycolipid antigen presented by a molecule called CD1d.

In some embodiments, the T cells comprise a mixture of $CD4^+$ cells. In other embodiments, the T cells are enriched for one or more subsets based on cell surface expression. For example, in some cases, the T comprise are cytotoxic $CD8^+$ T lymphocytes.

Natural-killer (NK) cells are $CD56^+CD3^-$ large granular lymphocytes that can kill virally infected and transformed cells, and constitute a critical cellular subset of the innate immune system (Godfrey J, et al. Leuk Lymphoma 2012 53:1666-1676). Unlike cytotoxic $CD8^+$ T lymphocytes, NK cells launch cytotoxicity against tumor cells without the requirement for prior sensitization, and can eradicate MHC-I-negative cells (Narni-Mancinelli E, et al. Int Immunol 2011 23:427-431). NK cells are safer effector cells, as they may avoid the potentially lethal complications of cytokine storms (Morgan R A, et al. Mol Ther 2010 18:843-851), tumor lysis syndrome (Porter D L, et al. N Engl J Med 2011 365:725-733), and on-target, off-tumor effects.

CD3 Multispecific Antigen-Binding Molecules

In certain embodiments, the methods and compositions provided herein relate to CD3 antigen-binding molecules (i.e., antigen binding molecules that comprise at least one antigen binding domain that binds to CD3). In certain embodiments, the CD3 multispecific antigen-binding molecules provided herein further comprise an antigen binding domain that binds to a cancer antigen (i.e., an antigen expressed on a cancer cell). In certain embodiments, the CD3 multispecific antigen-binding molecules provided herein further comprise an antigen binding domain that binds to a costimulatory receptor (e.g., CD28).

As used herein, the expression "multispecific antigen-binding molecule" refers to a protein, polypeptide or molecular complex comprising at least a first antigen-binding domain and a second antigen-binding domain. In some embodiments, each antigen-binding domain within the multispecific antigen-binding molecule may comprises at least one CDR that alone, or in combination with one or more additional CDRs and/or FRs, specifically binds to a particular antigen. In the context of the present invention, the first antigen-binding domain specifically binds a first antigen (e.g., CD3), and the second antigen-binding domain specifically binds a second, distinct antigen (e.g., a tumor antigen).

In some embodiments, the CD3 multispecific antigen-binding molecule is an CD3 multispecific antibody. The CD3 multispecific antibodies of provided herein may be, for example, bi-specific, or tri-specific. Multispecific antibodies may be specific for different epitopes of one target polypeptide or may contain antigen-binding domains specific for more than one target polypeptide. See, e.g., Tutt et al., 1991, J. Immunol. 147:60-69; Kufer et al., 2004, Trends Biotechnol. 22:238-244. The CD3 bispecific antibodies provided herein can be linked to or co-expressed with another functional molecule, e.g., another peptide or protein. For example, an antibody or fragment thereof can be functionally linked (e.g., by chemical coupling, genetic fusion, noncovalent association or otherwise) to one or more other molecular entities, such as another antibody or antibody fragment to produce a bi-specific or a multispecific antibody with a second or additional binding specificity.

The term "CD3," as used herein, refers to an antigen which is expressed on T cells as part of the multimolecular T cell receptor (TCR) and which consists of a homodimer or heterodimer formed from the association of two of four receptor chains: CD3-epsilon, CD3-delta, CD3-zeta, and CD3-gamma. Human CD3-epsilon comprises the amino acid sequence as set forth in SEQ ID NO:116 of U.S. Patent Application Publication No. US 2020/0024356A1 (SEQ ID NO: 1133), the content of which is incorporated by reference herein in its entirety; human CD3-delta comprises the amino acid sequence as set forth in SEQ ID NO:117 of U.S. Patent Application Publication No. US 2020/0024356A1 (SEQ ID NO: 1134), the content of which is incorporated by reference herein in its entirety; human CD3-zeta comprises the amino acid sequence as set forth in SEQ ID NO: 118 of U.S. Patent Application Publication No. US 2020/0024356A1 (SEQ ID NO: 1135), the content of which is incorporated by reference herein in its entirety; and CD3-gamma comprises the amino acid sequence as set forth in SEQ ID NO 119 of U.S. Patent Application Publication No. US 2020/0024356A1 (SEQ ID NO: 1136), the content of which is incorporated by reference herein in its entirety. All references to proteins, polypeptides and protein fragments herein are intended to refer to the human version of the respective protein, polypeptide or protein fragment unless explicitly specified as being from a non-human species. Thus, the expression "CD3" means human CD3 unless specified as being from a non-human species, e.g., "mouse CD3," "monkey CD3," etc.

As used herein, "an antibody that binds CD3" or an "anti-CD3 antibody" includes antibodies and antigen-binding fragments thereof that specifically recognize a single CD3 subunit (e.g., epsilon, delta, gamma or zeta), as well as antibodies and antigen-binding fragments thereof that specifically recognize a dimeric complex of two CD3 subunits (e.g., gamma/epsilon, delta/epsilon, and zeta/zeta CD3 dimers). The antibodies and antigen-binding fragments of the present invention may bind soluble CD3 and/or cell surface expressed CD3. Soluble CD3 includes natural CD3 proteins as well as recombinant CD3 protein variants such as, e.g., monomeric and dimeric CD3 constructs, that lack a transmembrane domain or are otherwise unassociated with a cell membrane.

As used herein, the expression "cell surface-expressed CD3" means one or more CD3 protein(s) that is/are expressed on the surface of a cell in vitro or in vivo, such that at least a portion of a CD3 protein is exposed to the extracellular side of the cell membrane and is accessible to an antigen-binding portion of an antibody. Cell surface-expressed CD3 includes CD3 proteins contained within the context of a functional T cell receptor in the membrane of a cell. Cell surface-expressed CD3 includes CD3 protein expressed as part of a homodimer or heterodimer on the surface of a cell (e.g., gamma/epsilon, delta/epsilon, and zeta/zeta CD3 dimers). Cell surface-expressed CD3 also includes a CD3 chain (e.g., CD3-epsilon, CD3-delta or CD3-gamma) that is expressed by itself, without other CD3 chain types, on the surface of a cell. A cell surface-expressed CD3 can comprise or consist of a CD3 protein expressed on the surface of a cell which normally expresses CD3 protein. Alternatively, cell surface-expressed CD3 can comprise or consist of CD3 protein expressed on the surface of a cell that normally does not express human CD3 on its surface but has been artificially engineered to express CD3 on its surface.

In some embodiments, the present invention includes bispecific antibodies wherein one arm of an immunoglobulin binds CD3, and the other arm of the immunoglobulin is specific for a cancer antigen (also referred to herein as a tumor antigen, or "TAA"). In some embodiments, the present invention includes trispecific antibodies wherein a first arm of an immunoglobulin binds CD3, a second arm of the immunoglobulin is specific for a tumor antigen, and a third arm of the immunoglobulin binds an additional T cell antigen (e.g., CD28) or an additional tumor antigen.

In some embodiments, the CD3-binding arm may comprise any of the HCVR/LCVR or CDR amino acid sequences as disclosed in WO 2014/047231 or WO 2017/053856. In certain embodiments, the CD3-binding arm binds to human CD3 and induces human T cell activation. In certain embodiments, the CD3-binding arm binds weakly to human CD3 and induces human T cell activation. In other embodiments, the CD3-binding arm binds weakly to human CD3 and induces tumor-associated antigen-expressing cell killing in the context of a bispecific or multispecific antibody. In other embodiments, the CD3-binding arm binds or associated weakly with human and cynomolgus (monkey) CD3, yet the binding interaction is not detectable by in vitro assays known in the art.

In certain embodiments, the multispecific antibodies or antigen-binding fragments for use in the present invention comprise an antigen-binding arm that binds to CD28, ICOS, HVEM, CD27, 4-1BB, OX40, DR3, GITR, CD30, SLAM, CD2, 2B4, CD226, TIM1, or TIM2 to induce T cell activation.

In certain embodiments, the CD3 multispecific antigen-binding molecule comprises an antigen-binding domain specific for a cancer antigen. In certain embodiments, the cancer antigen is selected from AIM-2, ALDH1A1, alpha-actinin-4, alpha-fetoprotein ("AFP"), ARTC1, B-RAF, BAGE-1, BCLX (L), BCMA, BCR-ABL fusion protein b3a2, beta-catenin, BING-4, CA-125, CALCA, carcinoembryonic antigen ("CEA"), CASP-5, CASP-8, CD20, CD274, CD45, Cdc27, CDK12, CDK4, CDKN2A, CEA, CLPP, COA-1, CPSF, CSNK1A1, CTAG1, CTAG2, cyclin D1, Cyclin-A1, dek-can fusion protein, DKK1, EFTUD2, Elongation factor 2, ENAH (hMena), Ep-CAM, EpCAM, EphA3, epithelial tumor antigen ("ETA"), ETV6-AML1 fusion protein, EZH2, FGF5, FLT3-ITD, FN1, G250/MN/CAIX, GAGE-1,2,8, GAGE-3,4,5,6,7, GAS7, glypican-3, GnTV, gp100/Pme117, GPNMB, HAUS3, Hepsin, HER-2/neu, HERV-K-MEL, HLA-A11, HLA-A2, HLA-DOB, hsp70-2, IDOL IGF2B3, IL13Ralpha2, Intestinal carboxyl esterase, K-ras, Kallikrein 4, KIF20A, KK-LC-1, KKLC1, KM-HN-1, KMHN1 also known as CCDC110, LAGE-1, LDLR-fucosyltransferaseAS fusion protein, Lengsin, M-CSF, MAGE-A1, MAGE-A10, MAGE-A12, MAGE-A2, MAGE-A3, MAGE-A4, MAGE-A6, MAGE-A9, MAGE-C1, MAGE-C2, malic enzyme, mammaglobin-A, MART2, MATN, MC1R, MCSP, mdm-2, ME1, Melan-A/MART-1, Meloe, Midkine, MMP-2, MMP-7, MUC1, MUC5AC, MUC16, mucin, MUM-1, MUM-2, MUM-3, Myosin, Myosin class I, N-raw, NA88-A, neo-PAP, NFYC, NY-BR-1, NY-ESO-1/LAGE-2, OA1, OGT, OS-9, P polypeptide, p53, PAP, PAX5, PBF, pml-RARalpha fusion protein, polymorphic epithelial mucin ("PEM"), PPP1R3B, PRAME, PRDX5, PSA, PSMA, PTPRK, RAB38/NY-MEL-1, RAGE-1, RBAF600, RGS5, RhoC, RNF43, RU2AS, SAGE, secernin 1, SIRT2, SNRPD1, SOX10, Sp17, SPA17, SSX-2, SSX-4, STEAP1, STEAP2, survivin, SYT-SSX1 or -SSX2 fusion protein, TAG-1, TAG-2, Telomerase, TGF-betaRII, TPBG, TRAG-3, Triosephosphate isomerase, TRP-1/gp75, TRP-2, TRP2-INT2, tyrosinase, tyrosinase ("TYR"), VEGF, WT1 and XAGE-1b/GAGED2a.

In some embodiments, the cancer antigen is include ADAM 17, BCMA, CA-IX, CD19, CD20, CD22, CD30, CD33, CD38, CD52, CD56, CD70, CD74, CD79b, CD123, CD138, CDH3, CEA, EphA2, EpCAM, ERBB2, ENPP3, EGFR, EGFR-vIII, FLT3, FOLR1, GD-2, glypican-3, gpA33, GPNMB, GPRC5D, HER2, HER3, LMP1, LMP2A, MUC16, Mesothelin, PSMA, PSCA, RON, ROR1, ROR2, STEAP1, STEAP2, SSTR2, SSTR5, 5T4, and Trop-2. In some embodiments, the tumore antigen may be CD19, CD123, STEAP2, CD20, SSTR2, CD38, STEAP1, 5T4, ENPP3, PSMA, MUC16, GPRC5D, or BCMA.

In some embodiments, the tumore antigen may be CD19, CD123, STEAP2, CD20, SSTR2, CD38, STEAP1, 5T4, ENPP3, PSMA, MUC16, GPRC5D, or BCMA.

In some embodiments, the cancer antigen is CD20, MUC16, BCMA, PSMA, or STEAP2.

CD20 is a non-glycosylated phosphoprotein expressed on the cell membranes of mature B cells. CD20 is considered a B cell tumor-associated antigen because it is expressed by more than 95% of B-cell non-Hodgkin lymphomas (NHLs) and other B-cell malignancies, but it is absent on precursor B-cells, dendritic cells and plasma cells. The human CD20 protein has the amino acid sequence shown in SEQ ID NO: 5 of U.S. Patent Application Publication No. US 2020/0129617 (SEQ ID NO: 1137), the content of which is incorporated by reference herein in its entirety.

MUC16 refers to mucin 16. MUC16 is a single transmembrane domain highly glycosylated integral membrane glycoprotein that is highly expressed in ovarian cancer. The amino acid sequence of human MUC16 is set forth in SEQ ID NO:1899 of U.S. Patent Application Publication No. US 2018/0118848A1 (SEQ ID NO: 1138), the content of which is incorporated by reference herein in its entirety.

BCMA refers to B-cell maturation antigen. BCMA (also known as TNFRSF17 and CD269) is a cell surface protein expressed on malignant plasma cells, and plays a central role in regulating B cell maturation and differentiation into immunoglobulin-producing plasma cells. The amino acid sequence of human BCMA is shown in SEQ ID NO: 115 of U.S. Patent Application Publication No. US 2020/0024356 (SEQ ID NO: 1139), the content of which is incorporated by reference herein in its entirety. It can also be found in GenBank accession number NP_001183.2.

PSMA refers to prostate-specific membrane antigen, also known as folate hydrolase 1 (FOLH1). PSMA is an integral, non-shed membrane glycoprotein that is highly expressed in prostate epithelial cells and is a cell-surface marker for prostate cancer. The amino acid sequence of human PSMA is set forth in SEQ ID NO: 7 of U.S. Patent Application Publication No. US 2020/0129617 (SEQ ID NO: 1140), the content of which is incorporated by reference herein in its entirety.

STEAP2 refers to six-transmembrane epithelial antigen of prostate 2. STEAP2 is an integral, six-transmembrane-spanning protein that is highly expressed in prostate epithelial cells and is a cell-surface marker for prostate cancer. STEAP2 is a 490-amino acid protein encoded by STEAP2 gene located at the chromosomal region 7q21 in humans. The amino acid sequence of human STEAP2 is set forth in SEQ ID NO: 9 of U.S. Patent Application Publication No. US 2020/0129617 (SEQ ID NO: 1141), the content of which is incorporated by reference herein in its entirety.

In some embodiments, the CD3 multispecific antibody may be a bispecific CD3×CD19 antibody, a bispecific CD3× GPRC5D antibody, a bispecific CD3×CD123 antibody, a bispecific CD3×STEAP2 antibody, a bispecific CD3×CD20 antibody, a bispecific CD3×SSTR 2 antibody, a bispecific CD3×CD38 antibody, a bispecific CD3×STEAP1 antibody, a bispecific CD3×5T4 antibody, a bispecific CD3×ENPP3 antibody, a bispecific CD3×MUC16 antibody, a bispecific CD3×BCMA antibody, a bispecific CD3×PSMA antibody, or a trispecific CD3×CD28×CD38 antibody.

In some embodiments, the present invention includes antibodies having the HCVR, LCVR and/or CDR amino acid sequences of the antibodies set forth herein, the anti-CD3 antibodies disclosed in WO 2014/047231 or WO 2017/053856, the bispecific anti-CD20×anti-CD3 antibodies disclosed in WO 2014/047231, the bispecific anti-PSMA× anti-CD3 antibodies disclosed in WO 2017/023761, the bispecific anti-MUC16×anti-CD3 antibodies disclosed in WO 2018/067331, the bispecific anti-STEAP2×anti-CD3 antibodies disclosed in WO 2018/058001, or the bispecific anti-BCMA×anti-CD3 antibodies disclosed in WO 2020/018820, each of which is incorporated herein by reference.

In certain embodiments, the mulitispecific antigen-binding molecule is a mulitispecific antibody or antigen-binding fragment thereof. Each antigen-binding domain of a mulitispecific antibody comprises a heavy chain variable domain (HCVR) and a light chain variable domain (LCVR). In the context of a bispecific antigen-binding molecule comprising a first and a second antigen-binding domain (e.g., a bispecific antibody), the CDRs of the first antigen-binding domain may be designated with the prefix "A1" and the CDRs of the second antigen-binding domain may be designated with the prefix "A2". Thus, the CDRs of the first antigen-binding domain may be referred to herein as A1-HCDR1, A1-HCDR2, and A1-HCDR3; and the CDRs of the second antigen-binding domain may be referred to herein as A2-HCDR1, A2-HCDR2, and A2-HCDR3. In the context of a trispecific antigen-binding molecule comprising a first, a second, and a third antigen-binding domain (e.g., a trispecific antibody), the CDRs of the first antigen-binding domain may be designated with the prefix "A1", the CDRs of the second antigen-binding domain may be designated with the prefix "A2", and the CDRs of the third antigen-binding domain may be designated with the prefix "A3". Thus, the CDRs of the first antigen-binding domain may be referred to herein as A1-HCDR1, A1-HCDR2, and A1-HCDR3; the CDRs of the second antigen-binding domain may be referred to herein as A2-HCDR1, A2-HCDR2, and A2-HCDR3; and the CDRs of the third antigen-binding domain may be referred to herein as A3-HCDR1, A3-HCDR2, and A3-HCDR3.

The bispecific antigen-binding molecules discussed above or herein may be bispecific antibodies. In some cases, the bispecific antibody comprises a human IgG heavy chain constant region. In some cases, the human IgG heavy chain constant region is isotype IgG1. In some cases, the human IgG heavy chain constant region is isotype IgG4. In various embodiments, the bispecific antibody comprises a chimeric hinge that reduces Fcγ receptor binding relative to a wild-type hinge of the same isotype.

The first antigen-binding domain and the second antigen-binding domain may be directly or indirectly connected to one another to form a bispecific antigen-binding molecule of the present invention. Alternatively, the first antigen-binding domain and the second antigen-binding domain may each be connected to a separate multimerizing domain. The association of one multimerizing domain with another multimerizing domain facilitates the association between the two antigen-binding domains, thereby forming a bispecific antigen-binding molecule. As used herein, a "multimerizing domain" is any macromolecule, protein, polypeptide, peptide, or amino acid that has the ability to associate with a second multimerizing domain of the same or similar structure or constitution. For example, a multimerizing domain may be a polypeptide comprising an immunoglobulin $C_H3$ domain. A non-limiting example of a multimerizing component is an Fc portion of an immunoglobulin (comprising a $C_H2$-$C_H3$ domain), e.g., an Fc domain of an IgG selected from the isotypes IgG1, IgG2, IgG3, and IgG4, as well as any allotype within each isotype group.

Bispecific antigen-binding molecules of the present invention will typically comprise two multimerizing domains, e.g., two Fc domains that are each individually part of a separate antibody heavy chain. The first and second multimerizing domains may be of the same IgG isotype such as, e.g., IgG1/IgG1, IgG2/IgG2, IgG4/IgG4. Alternatively, the first and second multimerizing domains may be of different IgG isotypes such as, e.g., IgG 1/IgG2, IgG1/IgG4, IgG2/IgG4, etc.

In certain embodiments, the multimerizing domain is an Fc fragment or an amino acid sequence of from 1 to about 200 amino acids in length containing at least one cysteine residue. In other embodiments, the multimerizing domain is a cysteine residue, or a short cysteine-containing peptide. Other multimerizing domains include peptides or polypeptides comprising or consisting of a leucine zipper, a helix-loop motif, or a coiled-coil motif.

Any bispecific antibody format or technology may be used to make the bispecific antigen-binding molecules of the present invention. For example, an antibody or fragment thereof having a first antigen binding specificity can be functionally linked (e.g., by chemical coupling, genetic fusion, noncovalent association or otherwise) to one or more other molecular entities, such as another antibody or antibody fragment having a second antigen-binding specificity to produce a bispecific antigen-binding molecule. Specific exemplary bispecific formats that can be used in the context of the present invention include, without limitation, e.g., scFv-based or diabody bispecific formats, IgG-scFv fusions, dual variable domain (DVD)-Ig, Quadroma, knobs-into-holes, common light chain (e.g., common light chain with knobs-into-holes, etc.), CrossMab, CrossFab, (SEED)body, leucine zipper, Duobody, IgG1/IgG2, dual acting Fab (DAF)-IgG, and Mab² bispecific formats (see, e.g., Klein et al. 2012, mAbs 4:6, 1-11, and references cited therein, for a review of the foregoing formats).

In the context of bispecific antigen-binding molecules provided herein, the multimerizing domains, e.g., Fc domains, may comprise one or more amino acid changes (e.g., insertions, deletions or substitutions) as compared to the wild-type, naturally occurring version of the Fc domain. For example, the invention includes bispecific antigen-binding molecules comprising one or more modifications in the Fc domain that results in a modified Fc domain having a modified binding interaction (e.g., enhanced or diminished) between Fc and FcRn. In one embodiment, the bispecific antigen-binding molecule comprises a modification in a $C_H2$ or a $C_H3$ region, wherein the modification increases the affinity of the Fc domain to FcRn in an acidic environment (e.g., in an endosome where pH ranges from about 5.5 to about 6.0). Non-limiting examples of such Fc modifications include, e.g., a modification at position 250 (e.g., E or Q); 250 and 428 (e.g., L or F); 252 (e.g., L/Y/F/W or T), 254 (e.g., S or T), and 256 (e.g., S/R/Q/E/D or T); or a modification at position 428 and/or 433 (e.g., L/R/S/P/Q or K) and/or 434 (e.g., H/F or Y); or a modification at position 250 and/or 428; or a modification at position 307 or 308 (e.g., 308F, V308F), and 434. In one embodiment, the modification comprises a 428L (e.g., M428L) and 434S (e.g., N434S) modification; a 428L, 259I (e.g., V259I), and 308F (e.g., V308F) modification; a 433K (e.g., H433K) and a 434 (e.g., 434Y) modification; a 252, 254, and 256 (e.g., 252Y, 254T, and 256E) modification; a 250Q and 428L modification (e.g., T250Q and M428L); and a 307 and/or 308 modification (e.g., 308F or 308P).

Tin certain embodiments, provided herein are bispecific antigen-binding molecules comprising a first $C_H3$ domain and a second Ig $C_H3$ domain, wherein the first and second Ig $C_H3$ domains differ from one another by at least one amino acid, and wherein at least one amino acid difference reduces binding of the bispecific antibody to Protein A as compared to a bi-specific antibody lacking the amino acid difference. In one embodiment, the first Ig $C_H3$ domain binds Protein A and the second Ig $C_H3$ domain contains a mutation that reduces or abolishes Protein A binding such as an H95R modification (by IMGT exon numbering; H435R by EU numbering). The second $C_H3$ may further comprise a Y96F modification (by IMGT; Y436F by EU). See, for example, U.S. Pat. No. 8,586,713. Further modifications that may be found within the second $C_H3$ include: D16E, L18M, N44S, K52N, V57M, and V82I (by IMGT; D356E, L358M, N384S, K392N, V397M, and V422I by EU) in the case of IgG1 antibodies; N44S, K52N, and V82I (IMGT; N384S, K392N, and V422I by EU) in the case of IgG2 antibodies; and Q15R, N44S, K52N, V57M, R69K, E79Q, and V82I (by IMGT; Q355R, N384S, K392N, V397M, R409K, E419Q, and V422I by EU) in the case of IgG4 antibodies.

In certain embodiments, the Fc domain may be chimeric, combining Fc sequences derived from more than one immunoglobulin isotype. For example, a chimeric Fc domain can comprise part or all of a $C_H2$ sequence derived from a human IgG1, human IgG2 or human IgG4 $C_H2$ region, and part or all of a $C_H3$ sequence derived from a human IgG1, human IgG2 or human IgG4. A chimeric Fc domain can also contain a chimeric hinge region. For example, a chimeric hinge may comprise an "upper hinge" sequence, derived from a human IgG1, a human IgG2 or a human IgG4 hinge region, combined with a "lower hinge" sequence, derived from a human IgG1, a human IgG2 or a human IgG4 hinge region. A particular example of a chimeric Fc domain that can be included in any of the antigen-binding molecules set forth herein comprises, from N- to C-terminus: [IgG4 $C_H1$]-[IgG4 upper hinge]-[IgG2 lower hinge]-[IgG4 CH2]-[IgG4 CH3]. Another example of a chimeric Fc domain that can be included in any of the antigen-binding molecules set forth herein comprises, from N- to C-terminus: [IgG1 $C_H1$]-[IgG1 upper hinge]-[IgG2 lower hinge]-[IgG4 CH2]-[IgG1 CH3]. These and other examples of chimeric Fc domains that can be included in any of the antigen-binding molecules of the present invention are described in US Publication 2014/0243504, published Aug. 28, 2014, which is herein incorporated in its entirety. Chimeric Fc domains having these general structural arrangements, and variants thereof, can have altered Fc receptor binding, which in turn affects Fc effector function.

The CD3 multispecific (e.g., bispecific or trispecific) antibodies disclosed herein may comprise one or more amino acid substitutions, insertions and/or deletions in the framework and/or CDR regions of the heavy and light chain variable domains as compared to the corresponding germline sequences from which the antibodies were derived. Such mutations can be readily ascertained by comparing the amino acid sequences disclosed herein to germline sequences available from, for example, public antibody sequence databases. The present invention includes antibodies, and antigen-binding fragments thereof, which are derived from any of the amino acid sequences disclosed herein, wherein one or more amino acids within one or more framework and/or CDR regions are mutated to the corresponding residue(s) of the germline sequence from which the antibody was derived, or to the corresponding residue(s) of another human germline sequence, or to a conservative amino acid substitution of the corresponding germline residue(s) (such sequence changes are referred to herein collectively as "germline mutations"). A person of ordinary skill in the art, starting with the heavy and light chain variable region sequences disclosed herein, can easily produce numerous antibodies and antigen-binding fragments which comprise one or more individual germline mutations or combinations thereof. In certain embodiments, all of the framework and/or CDR residues within the $V_H$ and/or $V_L$ domains are mutated back to the residues found in the original germline sequence from which the antibody was derived. In other embodiments, only certain residues are mutated back to the original germline sequence, e.g., only the mutated residues found within the first 8 amino acids of FR1 or within the last 8 amino acids of FR4, or only the mutated residues found within CDR1, CDR2 or CDR3. In other embodiments, one or more of the framework and/or CDR residue(s) are mutated to the corresponding residue(s) of a different germline sequence (i.e., a germline sequence that is different from the germline sequence from which the antibody was originally derived). Furthermore, the antibodies of the present invention may contain any combination of two or more germline mutations within the framework and/or CDR regions, e.g., wherein certain individual residues are mutated to the corresponding residue of a particular germline sequence while certain other residues that differ from the original germline sequence are maintained or are mutated to the corresponding residue of a different germline sequence. Once obtained, antibodies and antigen-binding fragments that contain one or more germline mutations can be easily tested for one or more desired property such as, improved binding specificity, increased binding (e.g., as measured by cell binding titration or FACS binding) or binding affinity (e.g., $K_D$), improved or enhanced antagonistic or agonistic biological properties (as the case may be), reduced immunogenicity, etc. Antibodies and antigen-binding fragments obtained in this general manner are encompassed within the present invention.

Provided herein are also CD3 multispecific (e.g., bispecific or trispecific) antibodies comprising variants of any of the HCVR, LCVR, and/or CDR amino acid sequences disclosed herein having one or more conservative substitutions. For example, the present invention includes anti-CD40 antagonist antibodies or CD3 multispecific (e.g., bispecific or trispecific) antibodies having HCVR, LCVR, and/or CDR amino acid sequences with, e.g., 10 or fewer, 8 or fewer, 6 or fewer, 4 or fewer, etc. conservative amino acid substitutions relative to any of the HCVR, LCVR, and/or CDR amino acid sequences disclosed herein.

Exemplary CD3×MUC16 Antibodies

In some embodiments, the methods and compositions provided herein include bispecific antibodies wherein one arm of an immunoglobulin binds human CD3, and the other arm of the immunoglobulin is specific for human MUC16. The term "MUC16," as used herein, refers to the human MUC16 protein unless specified as being from a non-human species (e.g., "mouse MUC16," "monkey MUC16," etc.). The human MUC16 protein has the amino acid sequence shown in SEQ ID NO: 1899 of U.S. Patent Application Publication No. US 2018/0118848A1 (SEQ ID NO: 1138), the content of which is incorporated by reference herein in its entirety. Such molecules may be referred to herein as, e.g., "anti-CD3/anti-MUC16," or "anti-CD3×MUC16" or "CD3×MUC16" bispecific molecules, or other similar terminology (e.g., anti-MUC16/anti-CD3). Such bispecific antigen-binding molecules are constructed with a first antigen-binding arm that binds MUC16 and a second antigen-binding arm that binds CD3. The MUC16-binding arm can comprise any of the HCVR/LCVR or CDR amino acid sequences as set forth in Table 1 herein. The CD3-binding arm can comprise any of the HCVR/LCVR or CDR amino acid sequences as set forth in Tables 2-6 herein. Sequences in Tables 1-6 were disclosed in U.S. Patent Application Publication No. US 2018/0118848A1, the the content of which is incorporated by reference herein in its entirety.

Table 1 sets forth the amino acid sequence identifiers of the heavy and light chain variable regions and CDRs of selected anti-MUC16 antibodies of the invention.

TABLE 1

Amino Acid Sequence Identifiers

| Antibody Designation | SEQ ID NOs: | | | | | | | |
|---|---|---|---|---|---|---|---|---|
| | HCVR | HCDR1 | HCDR2 | HCDR3 | LCVR | LCDR1 | LCDR2 | LCDR3 |
| H1H8755P | 1 | 30 | 59 | 88 | 117 | 146 | 175 | 204 |
| H1H8767P | 2 | 31 | 60 | 89 | 118 | 147 | 176 | 205 |
| H1H8770P | 3 | 32 | 61 | 90 | 119 | 148 | 177 | 206 |
| H1H8783P | 4 | 33 | 62 | 91 | 120 | 149 | 178 | 207 |
| H1H8790P | 5 | 34 | 63 | 92 | 121 | 150 | 179 | 208 |
| H1H8794P | 6 | 35 | 64 | 93 | 122 | 151 | 180 | 209 |
| H1H8794P2 | 7 | 36 | 65 | 94 | 123 | 152 | 181 | 210 |
| H1H8799P | 8 | 37 | 66 | 95 | 124 | 153 | 182 | 211 |
| H1H8799P2 | 9 | 38 | 67 | 96 | 125 | 154 | 183 | 212 |
| H1H8804P | 10 | 39 | 68 | 97 | 126 | 155 | 184 | 213 |
| H1H8808P | 11 | 40 | 69 | 98 | 127 | 156 | 185 | 214 |
| H1H8810P | 12 | 41 | 70 | 99 | 128 | 157 | 186 | 215 |
| H1H8813P | 13 | 42 | 71 | 100 | 129 | 158 | 187 | 216 |
| H1M7129N | 14 | 43 | 72 | 101 | 130 | 159 | 188 | 217 |
| H1M7137N | 15 | 44 | 73 | 102 | 131 | 160 | 189 | 218 |
| H1M9519N | 16 | 45 | 74 | 103 | 132 | 161 | 190 | 219 |
| H1M9521N | 17 | 46 | 75 | 104 | 133 | 162 | 191 | 220 |
| H1M9528N | 18 | 47 | 76 | 105 | 134 | 163 | 192 | 221 |
| H2M7128N | 19 | 48 | 77 | 106 | 135 | 164 | 193 | 222 |
| H1M7130N | 20 | 49 | 78 | 107 | 136 | 165 | 194 | 223 |
| H2M7131N | 21 | 50 | 79 | 108 | 137 | 166 | 195 | 224 |
| H2M7133N | 22 | 51 | 80 | 109 | 138 | 167 | 196 | 225 |
| H2M7134N | 23 | 52 | 81 | 110 | 139 | 168 | 197 | 226 |
| H2M7135N | 24 | 53 | 82 | 111 | 140 | 169 | 198 | 227 |
| H2M7138N | 25 | 54 | 83 | 112 | 141 | 170 | 199 | 228 |
| H2M9538N | 26 | 55 | 84 | 113 | 142 | 171 | 200 | 229 |
| H3M9524N | 27 | 56 | 85 | 114 | 143 | 172 | 201 | 230 |
| H3M9525N | 28 | 57 | 86 | 115 | 144 | 173 | 202 | 231 |
| H3M9529N | 29 | 58 | 87 | 116 | 145 | 174 | 203 | 232 |

Table 2 sets forth the amino acid sequence identifiers of the heavy and light chain variable regions and CDRs of selected anti-CD3 antibodies of the invention. Methods of making the anti-CD3 antibodies disclosed herein can also be found in US publication 2014/0088295.

TABLE 2

Amino Acid Sequence Identifiers

| Antibody Designation | SEQ ID NOs: | | | | | | | |
|---|---|---|---|---|---|---|---|---|
| | HCVR | HCDR1 | | HCDR3 | LCVR | LCDR11 | LCDR2 | LCDR3 |
| H1H2712N | 233 | 322 | 411 | 500 | 589 | 678 | 767 | 856 |
| H1M2692N | 234 | 323 | 412 | 501 | 590 | 679 | 768 | 857 |
| H1M3542N | 235 | 324 | 413 | 502 | 591 | 680 | 769 | 858 |

TABLE 2-continued

Amino Acid Sequence Identifiers

| Antibody Designation | SEQ ID NOs: | | | | | | | |
|---|---|---|---|---|---|---|---|---|
| | HCVR | HCDR1 | | HCDR3 | LCVR | LCDR11 | LCDR2 | LCDR3 |
| H1M3544N | 236 | 325 | 414 | 503 | 592 | 681 | 770 | 859 |
| H1M3549N | 237 | 326 | 415 | 504 | 593 | 682 | 771 | 860 |
| H1M3613N | 238 | 327 | 416 | 505 | 594 | 683 | 772 | 861 |
| H2M2689N | 239 | 328 | 417 | 506 | 595 | 684 | 773 | 862 |
| H2M2690N | 240 | 329 | 418 | 507 | 596 | 685 | 774 | 863 |
| H2M2691N | 241 | 330 | 419 | 508 | 597 | 686 | 775 | 864 |
| H2M2704N | 242 | 331 | 420 | 509 | 598 | 687 | 776 | 865 |
| H2M2705N | 243 | 332 | 421 | 510 | 599 | 688 | 777 | 866 |
| H2M2706N | 244 | 333 | 422 | 511 | 600 | 689 | 778 | 867 |
| H2M2707N | 245 | 334 | 423 | 512 | 601 | 690 | 779 | 868 |
| H2M2708N | 246 | 335 | 424 | 513 | 602 | 691 | 780 | 869 |
| H2M2709N | 247 | 336 | 425 | 514 | 603 | 692 | 781 | 870 |
| H2M2710N | 248 | 337 | 426 | 515 | 604 | 693 | 782 | 871 |
| H2M2711N | 249 | 338 | 427 | 516 | 605 | 694 | 783 | 872 |
| H2M2774N | 250 | 339 | 428 | 517 | 606 | 695 | 784 | 873 |
| H2M2775N | 251 | 340 | 429 | 518 | 607 | 696 | 785 | 874 |
| H2M2776N | 252 | 341 | 430 | 519 | 608 | 697 | 786 | 875 |
| H2M2777N | 253 | 342 | 431 | 520 | 609 | 698 | 787 | 876 |
| H2M2778N | 254 | 343 | 432 | 521 | 610 | 699 | 788 | 877 |
| H2M2779N | 255 | 344 | 433 | 522 | 611 | 700 | 789 | 878 |
| H2M2789N | 256 | 345 | 434 | 523 | 612 | 701 | 790 | 879 |
| H2M2862N | 257 | 346 | 435 | 524 | 613 | 702 | 791 | 880 |
| H2M2885N | 258 | 347 | 436 | 525 | 614 | 703 | 792 | 881 |
| H2M2886N | 259 | 348 | 437 | 526 | 615 | 704 | 793 | 882 |
| H2M3540N | 260 | 349 | 438 | 527 | 616 | 705 | 794 | 883 |
| H2M3541N | 261 | 350 | 439 | 528 | 617 | 706 | 795 | 884 |
| H2M3543N | 262 | 351 | 440 | 529 | 618 | 707 | 796 | 885 |
| H2M3547N | 263 | 352 | 441 | 530 | 619 | 708 | 797 | 886 |
| H2M3548N | 264 | 353 | 442 | 531 | 620 | 709 | 798 | 887 |
| H2M3563N | 265 | 354 | 443 | 532 | 621 | 710 | 799 | 888 |
| H1H5751P | 266 | 355 | 444 | 533 | 622 | 711 | 800 | 889 |
| H1H5752P | 267 | 356 | 445 | 534 | 623 | 712 | 801 | 890 |
| H1H5753B | 268 | 357 | 446 | 535 | 624 | 713 | 802 | 891 |
| H1H5754B | 269 | 358 | 447 | 536 | 625 | 714 | 803 | 892 |
| H1H5755B | 270 | 359 | 448 | 537 | 626 | 715 | 804 | 893 |
| H1H5756B | 271 | 360 | 449 | 538 | 627 | 716 | 805 | 894 |
| H1H5757B | 272 | 361 | 450 | 539 | 628 | 717 | 806 | 895 |
| H1H5758B | 273 | 362 | 451 | 540 | 629 | 718 | 807 | 896 |
| H1H5761P | 274 | 363 | 452 | 541 | 630 | 719 | 808 | 897 |
| H1H5763P | 275 | 364 | 453 | 542 | 631 | 720 | 809 | 898 |
| H1H5764P | 276 | 365 | 454 | 543 | 632 | 721 | 810 | 899 |
| H1H5769P | 277 | 366 | 455 | 544 | 633 | 722 | 811 | 900 |
| H1H5771P | 278 | 367 | 456 | 545 | 634 | 723 | 812 | 901 |
| H1H5772P | 279 | 368 | 457 | 546 | 635 | 724 | 813 | 902 |
| H1H5777P | 280 | 369 | 458 | 547 | 636 | 725 | 814 | 903 |
| H1H5778P | 281 | 370 | 459 | 548 | 637 | 726 | 815 | 904 |
| H1H5780P | 282 | 371 | 460 | 549 | 638 | 727 | 816 | 905 |
| H1H5781P | 283 | 372 | 461 | 550 | 639 | 728 | 817 | 906 |
| H1H5782P | 284 | 373 | 462 | 551 | 640 | 729 | 818 | 907 |
| H1H5785B | 285 | 374 | 463 | 552 | 641 | 730 | 819 | 908 |
| H1H5786B | 286 | 375 | 464 | 553 | 642 | 731 | 820 | 909 |
| H1H5788P | 287 | 376 | 465 | 554 | 643 | 732 | 821 | 910 |
| H1H5790B | 288 | 377 | 466 | 555 | 644 | 733 | 822 | 911 |
| H1H5791B | 289 | 378 | 467 | 556 | 645 | 734 | 823 | 912 |
| H1H5792B | 290 | 379 | 468 | 557 | 646 | 735 | 824 | 913 |
| H1H5793B | 291 | 380 | 469 | 558 | 647 | 736 | 825 | 914 |
| H1H5795B | 292 | 381 | 470 | 559 | 648 | 737 | 826 | 915 |
| H1H5796B | 293 | 382 | 471 | 560 | 649 | 738 | 827 | 916 |
| H1H5797B | 294 | 383 | 472 | 561 | 650 | 739 | 828 | 917 |
| H1H5798B | 295 | 384 | 473 | 562 | 651 | 740 | 829 | 918 |
| H1H5799P | 296 | 385 | 474 | 563 | 652 | 741 | 830 | 919 |
| H1H5801B | 297 | 386 | 475 | 564 | 653 | 742 | 831 | 920 |
| H1H7194B | 298 | 387 | 476 | 565 | 654 | 743 | 832 | 921 |
| H1H7195B | 299 | 388 | 477 | 566 | 655 | 744 | 833 | 922 |
| H1H7196B | 300 | 389 | 478 | 567 | 656 | 745 | 834 | 923 |
| H1H7198B | 301 | 390 | 479 | 568 | 657 | 746 | 835 | 924 |
| H1H7203B | 302 | 391 | 480 | 569 | 658 | 747 | 836 | 925 |
| H1H7204B | 303 | 392 | 481 | 570 | 659 | 748 | 837 | 926 |
| H1H7208B | 304 | 393 | 482 | 571 | 660 | 749 | 838 | 927 |
| H1H7211B | 305 | 394 | 483 | 572 | 661 | 750 | 839 | 928 |
| H1H7221B | 306 | 395 | 484 | 573 | 662 | 751 | 840 | 929 |
| H1H7223B | 307 | 396 | 485 | 574 | 663 | 752 | 841 | 930 |
| H1H7226B | 308 | 397 | 486 | 575 | 664 | 753 | 842 | 931 |
| H1H7232B | 309 | 398 | 487 | 576 | 665 | 754 | 843 | 932 |

TABLE 2-continued

Amino Acid Sequence Identifiers

| Antibody Designation | HCVR | HCDR1 | HCDR3 | LCVR | LCDR11 | LCDR2 | LCDR3 |
|---|---|---|---|---|---|---|---|
| H1H7233B | 310 | 399 | 488 | 577 | 666 | 755 | 844 | 933 |
| H1H7241B | 311 | 400 | 489 | 578 | 667 | 756 | 845 | 934 |
| H1H7242B | 312 | 401 | 490 | 579 | 668 | 757 | 846 | 935 |
| H1H7250B | 313 | 402 | 491 | 580 | 669 | 758 | 847 | 936 |
| H1H7251B | 314 | 403 | 492 | 581 | 670 | 759 | 848 | 937 |
| H1H7254B | 315 | 404 | 493 | 582 | 671 | 760 | 849 | 938 |
| H1H7258B | 316 | 405 | 494 | 583 | 672 | 761 | 850 | 939 |
| H1H7269B | 317 | 406 | 495 | 584 | 673 | 762 | 851 | 940 |
| H1H7279B | 318 | 407 | 496 | 585 | 674 | 763 | 852 | 941 |
| H1xH7221G | 319 | 408 | 497 | 586 | 675 | 764 | 853 | 942 |
| H1xH7221G3 | 320 | 409 | 498 | 587 | 676 | 765 | 854 | 943 |
| H1xH7221G5 | 321 | 410 | 499 | 588 | 677 | 766 | 855 | 944 |

Tables 3 and 4 set out the amino acid sequence identifiers for heavy chain variable regions (Table 3) and light chain variable regions (Table 4), and their corresponding CDRs, of additional anti-CD3 HCVRs and LCVRs useful in anti-MUC16×anti-CD3 bispecific antibodies of the invention.

TABLE 3

(Heavy Chain Variable Region Amino Acid Sequences)

| Heavy Chain Identifier | HCVR | HCDR1 | HCDR2 | HCDR3 |
|---|---|---|---|---|
| CD3-VH-AA | 945 | 951 | 957 | 963 |
| CD3-VH-B | 946 | 952 | 958 | 964 |
| CD3-VH-C | 947 | 953 | 959 | 965 |
| CD3-VH-D | 948 | 954 | 960 | 966 |
| CD3-VH-E | 949 | 955 | 961 | 967 |
| CD3-VH-F# | 950 | 956 | 962 | 968 |

TABLE 4

(Light Chain Variable Region Amino Acid Sequences)

| Light Chain Identifier | LCVR | LCDR1 | LCDR2 | LCDR3 |
|---|---|---|---|---|
| CD3-VL-AA | 969 | 975 | 981 | 987 |
| CD3-VL-B | 970 | 976 | 982 | 988 |
| CD3-VL-C | 971 | 977 | 983 | 989 |
| CD3-VL-D | 972 | 978 | 984 | 990 |
| CD3-VL-E | 973 | 979 | 985 | 991 |
| CD3-VL-F# | 974 | 980 | 986 | 992 |

Table 5 sets forth the amino acid sequence identifiers of the heavy chain variable regions and CDRs of engineered anti-CD3 antibodies of the invention. The amino acid sequence identifiers of the light chain variable region and CDRs are also identified below in Table 6.

TABLE 5

Heavy Chain Amino Acid Sequence Identifiers

| Antibody CD3-VH Designation | HCVR | CDR1 | CDR2 | CDR3 |
|---|---|---|---|---|
| CD3-VH-G | 993 | 1013 | 1033 | 1053 |
| CD3-VH-G2 | 994 | 1014 | 1034 | 1054 |
| CD3-VH-G3 | 995 | 1015 | 1035 | 1055 |
| CD3-VH-G4 | 996 | 1016 | 1036 | 1056 |
| CD3-VH-G5 | 997 | 1017 | 1037 | 1057 |
| CD3-VH-G8 | 998 | 1018 | 1038 | 1058 |
| CD3-VH-G9 | 999 | 1019 | 1039 | 1059 |
| CD3-VH-G10 | 1000 | 1020 | 1040 | 1060 |
| CD3-VH-G11 | 1001 | 1021 | 1041 | 1061 |
| CD3-VH-G12 | 1002 | 1022 | 1042 | 1062 |
| CD3-VH-G13 | 1003 | 1023 | 1043 | 1063 |
| CD3-VH-G14 | 1004 | 1024 | 1044 | 1064 |
| CD3-VH-G15 | 1005 | 1025 | 1045 | 1065 |
| CD3-VH-G16 | 1006 | 1026 | 1046 | 1066 |
| CD3-VH-G17 | 1007 | 1027 | 1047 | 1067 |
| CD3-VH-G18 | 1008 | 1028 | 1048 | 1068 |
| CD3-VH-G19 | 1009 | 1029 | 1049 | 1069 |
| CD3-VH-G20 | 1010 | 1030 | 1050 | 1070 |
| CD3-VH-G21 | 1011 | 1031 | 1051 | 1071 |
| CD3-VH-P | 1012 | 1032 | 1052 | 1072 |

TABLE 6

Light Chain Amino Acid Sequence Identifiers

| Antibody Designation | LCVR | CDR1 | CDR2 | CDR3 |
|---|---|---|---|---|
| VK1-39JK5 | 1073 | 1074 | 1075 | 1076 |

In certain exemplary embodiments, the first antigen-binding domain that specifically binds human CD3 comprises heavy chain complementarity determining regions (HCDR1, HCDR2 and HCDR3) from a heavy chain variable region (HCVR) selected from the group consisting of SEQ ID NOs: 993, 997, 999, 1000, and 1010, and light chain complementarity determining regions (LCDR1, LCDR2 and LCDR3) from a light chain variable region (LCVR) comprising an amino acid sequence of SEQ ID NO: 118.

In certain exemplary embodiments, the first antigen-binding domain that specifically binds human CD3 comprises three heavy chain complementarity determining regions (A1-HCDR1, A1-HCDR2 and A1-HCDR3) and three light chain complementarity determining regions (A1-LCDR1, A1-LCDR2 and A1-LCDR3), wherein A1-HCDR1 comprises an amino acid sequence selected from the group consisting of SEQ ID NOs:1013, 1017, 1019, 1020, and 1030; A1-HCDR2 comprises an amino acid sequence selected from the group consisting of SEQ ID NOs:1033, 1037, 1039, 1040, and 1050; A1-HCDR3 comprises an amino acid sequence selected from the group consisting of SEQ ID NOs: 1053, 1057, 1059, 1060, and 1070; A1-LCDR1 comprises an amino acid sequence of SEQ ID NO: 147; A1-LCDR2 comprises an amino acid sequence of SEQ ID NO: 176; and A1-LCDR3 comprises an amino acid sequence of SEQ ID NO: 205.

In certain exemplary embodiments, the first antigen-binding domain that specifically binds human CD3 comprises the heavy and light chain CDRs of a HCVR/LCVR amino acid sequence pair selected from the group consisting of: SEQ ID NOs: 993/118, 997/118, 999/118, 1000/118, and 1010/118.

In certain exemplary embodiments, the first antigen-binding domain that specifically binds human CD3 comprises three heavy chain complementarity determining regions (A1-HCDR1, A1-HCDR2 and A1-HCDR3) and three light chain complementarity determining regions (A1-LCDR1, A1-LCDR2 and A1-LCDR3), and the second antigen-binding domain that specifically binds human MUC16 comprises three heavy chain complementarity determining regions (A2-HCDR1, A2-HCDR2 and A2-HCDR3) and three light chain complementarity determining regions (A2-LCDR1, A2-LCDR2 and A2-LCDR3); wherein A1-HCDR1 comprises an amino acid sequence selected from the group consisting of SEQ ID NOs: 1013, 1017, 1019, 1020, and 1030; A1-HCDR2 comprises an amino acid sequence selected from the group consisting of SEQ ID NOs: 1033, 1037, 1039, 1040, and 1050; A1-HCDR3 comprises an amino acid sequence selected from the group consisting of SEQ ID NOs: 1053, 1057, 1059, 1060, and 1070; A1-LCDR1 comprises an amino acid sequence of SEQ ID NO: 147; A1-LCDR2 comprises an amino acid sequence of SEQ ID NO: 176; and A1-LCDR3 comprises an amino acid sequence of SEQ ID NO: 205; and wherein A2-HCDR1 comprises an amino acid sequence of SEQ ID NO: 31; A2-HCDR2 comprises an amino acid sequence of SEQ ID NO: 60; A2-HCDR3 comprises an amino acid sequence of SEQ ID NO: 89; A2-LCDR1 comprises an amino acid sequence of SEQ ID NO: 147; A2-LCDR2 comprises an amino acid sequence of SEQ ID NO: 176; and A2-LCDR3 comprises an amino acid sequence of SEQ ID NO: 205.

Additional bispecific anti-MUC16×anti-CD3 antibodies disclosed in, e.g., WO 2018/067331, which is hereby incorporated by reference.

Exemplary CD3×BCMA Antibodies

In some embodiments, the methods and compositions provided herein include bispecific antibodies wherein one arm of an immunoglobulin binds human CD3, and the other arm of the immunoglobulin is specific for human BCMA. The term "BCMA," as used herein, refers to the human BCMA protein unless specified as being from a non-human species (e.g., "mouse BCMA," "monkey BCMA," etc.). The human BCMA protein has the amino acid sequence shown in SEQ ID NO: 115 of U.S. Patent Application Publication No. US 2020/0024356A1 (SEQ ID NO: 1139), the content of which is incorporated herein by reference in its entirety. Such molecules may be referred to herein as, e.g., "anti-BCMA×anti-CD3" or "anti-CD3/anti-BCMA," or "anti-CD3×BCMA" or "CD3×BCMA" bispecific molecules, or other similar terminology (e.g., anti-BCMA/anti-CD3). The BCMA-binding arm can comprise any of the HCVR/LCVR or CDR amino acid sequences as set forth in Table 7 herein. The CD3-binding arm can comprise any of the HCVR/LCVR or CDR amino acid sequences as set forth in Table 8 herein, or the anti-CD3 antibodies disclosed in WO 2014/047231 or WO 2017/053856. Sequences in Tables 7 and 8 were disclosed in U.S. Patent Application Publication No. US 2020/0024356A1, the content of which is incorporated herein by reference in its entirety.

Table 7 sets forth the amino acid sequence identifiers of the heavy and light chain variable regions and CDRs of selected anti-BCMA antibodies of the invention.

TABLE 7

Amino Acid Sequence Identifiers

| Antibody Designation | SEQ ID NOs: | | | | | | | |
|---|---|---|---|---|---|---|---|---|
| | HCVR | HCDR1 | HCDR2 | HCDR3 | LCVR | LCDR1 | LCDR2 | LCDR3 |
| mAb16711 | 1077 | 1084 | 1089 | 1094 | 1099 | 1106 | 1111 | 1116 |
| mAb16716 | 1078 | 1085 | 1090 | 1095 | 1100 | 1107 | 1112 | 1117 |
| mAb16732 | 1079 | 1086 | 1091 | 1096 | 1101 | 1108 | 1113 | 1118 |
| mAb16747 | 1080 | 1087 | 1092 | 1097 | 1102 | 1109 | 1114 | 1119 |
| mAb21581 | 1081 | 1088 | 1093 | 1098 | 1103 | 1110 | 1115 | 1120 |
| mAb21587 | 1082 | | | | 1104 | | | |
| mAb21589 | 1083 | | | | 1105 | | | |

Table 8 sets forth the amino acid sequence identifiers of the heavy and light chain variable regions and CDRs of selected anti-CD3 antibodies. Other anti-CD3 antibodies for use in preparing bispecific antibodies in accordance with the present invention can be found in, e.g., WO 2014/047231.

TABLE 8

Amino Acid Sequence Identifiers

| Antibody Designation | SEQ ID NOs: | | | | | | | |
|---|---|---|---|---|---|---|---|---|
| | HCVR | HCDR1 | HCDR2 | HCDR3 | LCVR | LCDR1 | LCDR2 | LCDR3 |
| mAb7221G | 1121 | 1123 | 1125 | 1127 | 1129 | 1130 | 1131 | 1132 |
| mAb7221G20 | 1122 | 1124 | 1126 | 1128 | 1129 | 1130 | 1131 | 1132 |

In certain exemplary embodiments, the isolated anti-BCMA×anti-CD3 bispecific antigen binding molecule comprises a first antigen-binding domain that comprises: (a) three heavy chain complementarity determining regions (HCDR1, HCDR2 and HCDR3) contained within a heavy chain variable region (HCVR) comprising the amino acid sequence of SEQ ID NO: 1081; and (b) three light chain complementarity determining regions (LCDR1, LCDR2 and LCDR3) contained within a light chain variable region (LCVR) comprising the amino acid sequence of SEQ ID NO: 1129. In some cases, the isolated bispecific antigen binding molecule comprises a HCDR1 comprising the amino acid sequence of SEQ ID NO: 1088, a HCDR2 comprising the amino acid sequence of SEQ ID NO: 1093, and a HCDR3 comprising the amino acid sequence of SEQ ID NO: 1098. In some cases, the isolated bispecific antigen-binding molecule comprises a LCDR1 comprising the amino acid sequence of SEQ ID NO: 1130, a LCDR2 comprising the amino acid sequence of SEQ ID NO: 1131, and a LCDR3 comprising the amino acid sequence of SEQ ID NO: 1132. In some cases, the first antigen-binding domain comprises a HCVR comprising the amino acid sequence of SEQ ID NO: 1081, and a LCVR comprising the amino acid sequence of SEQ ID NO: 1129.

In certain exemplary embodiments, the isolated anti-BCMA×anti-CD3 bispecific antigen-binding molecule comprises a second antigen-binding domain that comprises: (a) three heavy chain complementarity determining regions (HCDR1, HCDR2 and HCDR3) contained within a heavy chain variable region (HCVR) comprising the amino acid sequence of SEQ ID NO: 1121 or SEQ ID NO: 1122; and (b) three light chain complementarity determining regions (LCDR1, LCDR2 and LCDR3) contained within a light chain variable region (LCVR) comprising the amino acid sequence of SEQ ID NO: 1129. In some cases, the second antigen-binding domain comprises: (a) a HCDR1 comprising the amino acid sequence of SEQ ID NO: 1123 or SEQ ID NO: 1124; (b) a HCDR2 comprising the amino acid sequence of SEQ ID NO: 1125 or SEQ ID NO: 1126; and (c) a HCDR3 comprising the amino acid sequence of SEQ ID NO: 1127 or SEQ ID NO: 1128. In some cases, the second antigen-binding domain comprises a LCDR1 comprising the amino acid sequence of SEQ ID NO: 1130, a LCDR2 comprising the amino acid sequence of SEQ ID NO: 1131, and a LCDR3 comprising the amino acid sequence of SEQ ID NO: 1132. In some cases, the second antigen-binding domain comprises: (a) HCDR1, HCDR2, HCDR3 domains, respectively, comprising the amino acid sequences of SEQ ID NOs: 1123, 1125, 1127; and LCDR1, LCDR2, LCDR3 domains, respectively, comprising the amino acid sequences of SEQ ID NOs: 1130, 1131, 1132; or (b) HCDR1, HCDR2, HCDR3 domains, respectively, comprising the amino acid sequences of SEQ ID NOs: 1124, 1126, 1128; and LCDR1, LCDR2, LCDR3 domains, respectively, comprising the amino acid sequences of SEQ ID NOs: 1130, 1131, 1132. In some cases, the second antigen-binding domain comprises: (a) a HCVR comprising the amino acid sequence of SEQ ID NO: 1121, and a LCVR comprising the amino acid sequence of SEQ ID NO: 1129; or (b) a HCVR comprising the amino acid sequence of SEQ ID NO: 1122, and a LCVR comprising the amino acid sequence of SEQ ID NO: 1129.

In certain exemplary embodiments, the isolated anti-BCMA×anti-CD3 bispecific antigen-binding molecule comprises: (a) a first antigen-binding domain that comprises HCDR1, HCDR2, HCDR3 domains, respectively, comprising the amino acid sequences of SEQ ID NOs: 1088, 1093, 1098, and LCDR1, LCDR2, LCDR3 domains, respectively, comprising the amino acid sequences of SEQ ID NOs: 1130, 1131, 1132; and (b) a second antigen binding domain that comprises HCDR1, HCDR2, HCDR3 domains, respectively, comprising the amino acid sequences of SEQ ID NOs: 1123, 1125, 1127, and LCDR1, LCDR2, LCDR3 domains, respectively, comprising the amino acid sequences of SEQ ID NOs: 1130, 1131, 1132. In some cases, the isolated bispecific antigen-binding molecule comprises: (a) a first antigen binding domain that comprises a HCVR comprising the amino acid sequence of SEQ ID NO: 1081, and a LCVR comprising the amino acid sequence of SEQ ID NO: 1129; and (b) a second antigen binding domain that comprises a HCVR comprising the amino acid sequence of SEQ ID NO: 1121, and a LCVR comprising the amino acid sequence of SEQ ID NO:1129.

In certain exemplary embodiments, the isolated anti-BCMA×anti-CD3 bispecific antigen-binding molecule comprises: (a) a first antigen-binding domain that comprises HCDR1, HCDR2, HCDR3 domains, respectively, comprising the amino acid sequences of SEQ ID NOs: 1088, 1093, 1098, and LCDR1, LCDR2, LCDR3 domains, respectively, comprising the amino acid sequences of SEQ ID NOs: 1130, 1131, 1132; and (b) a second antigen binding domain that comprises HCDR1, HCDR2, HCDR3 domains, respectively, comprising the amino acid sequences of SEQ ID NOs: 1124, 1126, 1128, and LCDR1, LCDR2, LCDR3 domains, respectively, comprising the amino acid sequences of SEQ ID NOs: 1130, 1131, 1132. In some cases, the isolated bispecific antigen-binding molecule comprises: (a) a first antigen binding domain that comprises a HCVR comprising the amino acid sequence of SEQ ID NO: 1081, and a LCVR comprising the amino acid sequence of SEQ ID NO: 1129; and (b) a second antigen binding domain that comprises a HCVR comprising the amino acid sequence of SEQ ID NO: 1122, and a LCVR comprising the amino acid sequence of SEQ ID NO: 1129.

In certain exemplary embodiments, the isolated anti-BCMA×anti-CD3 bispecific antigen-binding molecule comprises: (a) a first antigen-binding domain that specifically binds human BCMA, and comprises the CDRs of a HCVR comprising an amino acid sequence selected from the group consisting of SEQ ID NOs: 1077, 1078, 1079, 1080, 1081, 1082, and 1083, and the CDRs of a LCVR comprising an amino acid sequence selected from the group consisting of SEQ ID NO: 1099, 1100, 1101, 1102, 1103, 1129, 1104, and 1105; and (b) a second antigen-binding domain that specifically binds human CD3. In some cases, the first antigen-binding domain comprises the CDRs from a HCVR/LCVR amino acid sequence pair selected from the group consisting of SEQ ID NOs: 1077/1099, 1078/1100, 1079/1101, 1080/1102, 1081/1103, 1082/1104, 1083/1105, 1077/1129, 1078/1129, 1079/1129, 1080/1129, 1081/1129, 1082/1129, and 1083/1129. In some cases, the first antigen-binding domain comprises HCDR1-HCDR2-HCDR3-LCDR1-LCDR2-LCDR3 domains, respectively, selected from the group consisting of SEQ ID NOs: 1084-1089-1094-1106-1111-1116, 1085-1090-1095-1107-1112-1117, 1086-1091-1096-1108-1113-1118, 1087-1092-1097-1109-1114-1119, 1088-1093-1098-1110-1115-1120, 1084-1089-1094-1130-1131-1132, 1085-1090-1095-1130-1131-1132, 1086-1091-1096-1130-1131-1132, 1087-1092-1097-1130-1131-1132, and 1088-1093-1098-1130-1131-1132. In some cases, the first antigen-binding domain comprises the a HCVR/LCVR amino acid sequence pair selected from the group consisting of SEQ ID NOs: 1077/1099, 1078/1100, 1079/1101, 1080/1102, 1081/1103, 1082/1104, 1083/1105, 1077/1129, 1078/1129, 1079/1129, 1080/1129, 1081/1129, 1082/1129, and 1083/1129. In some cases, the second antigen-binding domain comprises the CDRs of a HCVR/LCVR amino acid sequence pair selected from the group consisting of SEQ ID NOs: 1121/1129 and 1122/1129.

In certain exemplary embodiments, the isolated anti-BCMA×anti-CD3 bispecific antigen binding molecule competes for binding to BCMA, or binds to the same epitope on BCMA as a reference antibody, wherein the reference antibody comprises a first antigen-binding domain comprising an HCVR/LCVR pair comprising the amino acid sequences of SEQ ID NOs: 1081/1129 and a second antigen-binding domain comprising an HCVR/LCVR pair comprising the amino acid sequences of either SEQ ID NOs: 1121/1129 or SEQ ID NOs: 1122/1129.

In certain exemplary embodiments, the isolated anti-BCMA×anti-CD3 bispecific antigen binding molecule competes for binding to human CD3, or binds to the same epitope on human CD3 as a reference antibody, wherein the reference antibody comprises a first antigen-binding domain comprising an HCVR/LCVR pair comprising the amino acid sequences of SEQ ID NOs: 1081/1129 and a second antigen-binding domain comprising an HCVR/LCVR pair comprising the amino acid sequences of either SEQ ID NOs: 1121/1129 or SEQ ID NOs: 1122/1129.

Additional bispecific anti-BCMA×anti-CD3 antibodies are disclosed in, e.g., WO 2020/018820.

CD3×CD20 Antibodies

In some embodiments, provided herein are bispecific antibodies wherein one arm of an immunoglobulin binds human CD3, and the other arm of the immunoglobulin is specific for human CD20. The term "CD20," as used herein, refers to the human CD20 protein unless specified as being from a non-human species (e.g., "mouse CD20," "monkey CD20," etc.). The human CD20 protein has the amino acid sequence shown in SEQ ID NO:1369 of U.S. Pat. No. 9,657,102B2 (SEQ ID NO: 1142), the content of which is incorporated by reference herein in it entirety. Such molecules may be referred to herein as, e.g., "anti-CD3/anti-CD20," or "anti-CD3×CD20" or "CD3×CD20" bispecific molecules, or other similar terminology.

In certain embodiments, the first antigen-binding domain that specifically binds CD3 comprises a heavy chain variable region (HCVR) having an amino acid sequence selected from the group consisting of SEQ ID NOs: 1147, 1155, 1163, 1171, 1179 and 1187 or a substantially similar sequence thereof having at least 90%, at least 95%, at least 98% or at least 99% sequence identity. All sequences disclosed in this section for antigen-binding domains that specifically bind CD3 or CD20 are from U.S. Pat. No. 9,657,102B2, the content of which is incorporated by reference herein in it entirety.

In certain embodiments, the first antigen-binding domain that specifically binds CD3 comprises a light chain variable region (LCVR) having an amino acid sequence selected from the group consisting of SEQ ID NOs: 1151, 1159, 1167, 1175, 1183 and 1191, or a substantially similar sequence thereof having at least 90%, at least 95%, at least 98% or at least 99% sequence identity.

In certain embodiments, the first antigen-binding domain that specifically binds CD3 comprises a HCVR and LCVR (HCVR/LCVR) amino acid sequence pair selected from the group consisting of SEQ ID NOs: 1147/1151, 1155/1159, 1163/1167, 1171/1175, 1179/1183, and 1187/1191.

In certain embodiments, the first antigen-binding domain that specifically binds CD3 comprises a heavy chain CDR1 (HCDR1) domain having an amino acid sequence selected from the group consisting of SEQ ID NOs: 1148, 1156, 1164, 1172, 1180 and 1188, or a substantially similar sequence thereof having at least 90%, at least 95%, at least 98% or at least 99% sequence identity; a heavy chain CDR2 (HCDR2) domain having an amino acid sequence selected from the group consisting of SEQ ID NOs:1149, 1157, 1165, 1173, 1181 and 1189, or a substantially similar sequence thereof having at least 90%, at least 95%, at least 98% or at least 99% sequence identity; a heavy chain CDR3 (HCDR3) domain having an amino acid sequence selected from the group consisting of SEQ ID NOs:1150, 1158, 1166, 1174, 1182 and 1190, or a substantially similar sequence thereto having at least 90%, at least 95%, at least 98% or at least 99% sequence identity; a light chain CDR1 (LCDR1) domain having an amino acid sequence selected from the group consisting of SEQ ID NOs: 1152, 1160, 1168, 1176, 1184 and 1192, or a substantially similar sequence thereof having at least 90%, at least 95%, at least 98% or at least 99% sequence identity; a light chain CDR2 (LCDR2) domain having an amino acid sequence selected from the group consisting of SEQ ID NOs:1153, 1161, 1169, 1177, 1185 and 1193, or a substantially similar sequence thereof having at least 90%, at least 95%, at least 98% or at least 99% sequence identity, and a light chain CDR3 (LCDR3) domain having an amino acid sequence selected from the group consisting of SEQ ID NOs:1154, 1162, 1170, 1178, 1186 and 1194, or a substantially similar sequence thereof having at least 90%, at least 95%, at least 98% or at least 99% sequence identity.

In certain embodiments, the first antigen-binding domain that specifically binds CD3 comprises HCDR1-HCDR2-HCDR3-LCDR1-LCDR2-LCDR3 domains, respectively, having the amino acid sequences selected from the group consisting of: SEQ ID NOs: 1148-1149-1150-1152-1153-1154; 1156-1157-1158-1160-1161-1162; 1164-1165-1166-1168-1169-1170; 1172-1173-1174-1176-1177-1178; 1180-1181-1182-1184-1185-1186; and 1188-1189-1190-1192-1193-1194.

In certain embodiments, the second antigen-binding domain that specifically binds CD20 comprises a heavy chain variable region (HCVR) having the amino acid sequence of SEQ ID NO: 1143, or a substantially similar sequence thereof having at least 90%, at least 95%, at least 98% or at least 99% sequence identity.

In certain embodiments, the second antigen-binding domain that specifically binds CD20 comprises a light chain variable region (LCVR) having the amino acid sequence selected from the group consisting of SEQ ID NOs: 1151, 1159, 1167, 1175, 1183 and 1191, or a substantially similar sequence thereof having at least 90%, at least 95%, at least 98% or at least 99% sequence identity.

In certain embodiments, the second antigen-binding domain that specifically binds CD20 comprises a HCVR and LCVR (HCVR/LCVR) amino acid sequence pair selected from the group consisting of SEQ ID NOs: 1143/1151, 1143/1159, 1143/1167, 1143/1175, 1143/1183 and 1143/1191.

In certain embodiments, the second antigen-binding domain that specifically binds CD20 comprises a heavy chain CDR1 (HCDR1) domain having the amino acid sequence of SEQ ID NO:1144, or a substantially similar sequence thereof having at least 90%, at least 95%, at least 98% or at least 99% sequence identity; a heavy chain CDR2 (HCDR2) domain having the amino acid sequence of SEQ ID NO: 1145, or a substantially similar sequence thereof having at least 90%, at least 95%, at least 98% or at least 99% sequence identity; a heavy chain CDR3 (HCDR3) domain having the amino acid sequence of SEQ ID NO:1146, or a substantially similar sequence thereto having at least 90%, at least 95%, at least 98% or at least 99% sequence identity; a light chain CDR1 (LCDR1) domain having an amino acid sequence selected from the group consisting of SEQ ID NOs: 1152, 1160, 1168, 1176, 1184 and 1192, or a substantially similar sequence thereof having at least 90%, at least 95%, at least 98% or at least 99% sequence identity; a light chain CDR2 (LCDR2) domain having an amino acid sequence selected from the group consisting of SEQ ID NOs:1153, 1161, 1169, 1177, 1185 and 1193, or a substantially similar sequence thereof having at least 90%, at least 95%, at least 98% or at least 99% sequence identity; and a light chain CDR3 (LCDR3) domain having an amino acid sequence selected from the group consisting of SEQ ID NOs:1154, 1162, 1170, 1178, 1186 and 1194, or a substantially similar sequence thereof having at least 90%, at least 95%, at least 98% or at least 99% sequence identity.

In certain embodiments, the second antigen-binding domain that specifically binds CD20 comprises HCDR1-HCDR2-HCDR3-LCDR1-LCDR2-LCDR3 domains, respectively, having the amino acid sequences selected from the group consisting of: SEQ ID NOs:1144-1145-1146-1152-1153-1154; 1144-1145-1146-1160-1161-1162; 1144-1145-1146-1168-1169-1170; 1144-1145-1146-1176-1177-1178; 1144-1145-1146-1184-1185-1186; and 1144-1145-1146-1192-1193-1194.

Additional bispecific anti-CD20/anti-CD3 antibodies are disclosed in e.g., U.S. Pat. No. 9,657,102, which is incorporated by reference herein in its entirety.

Other Exemplary CD3 Multispecific Antibodies

Additional exemplary CD3 multispecific antibodies that can be used in the compositions and methods of the present invention include but are not limited to, e.g., bispecific CD3×CD123 antibodies disclosed in U.S. Pat. No. 10,787,521B2, U.S. Patent Application Publication Nos. 2018/0222987A1 and US 2019/0241657A1, and International Application Publication Nos. WO 2016/036937A1, WO 2017/210443A1, WO 2019/050521A1, WO 2019/210147A1, WO 2019/232528A1, and WO 2020/092404A1; bispecific CD3×STEAP2 antibodies disclosed in International Application Publication Nos. WO 2018/058001A1; bispecific CD3×CD20 antibodies disclosed in WO 2014/047231A1, WO 2015/143079A1, WO 2016/081490A1, WO 2017/112775A1, WO 2017/210485A1, WO 2018/114748A1, WO 2018/093821A8, WO 2018/223004A1, WO 2018/188612A1, WO 2019/155008A1, WO 2019/228406A1, WO 2020/088608A1, WO 2020/156405A1, and U.S. Patent Application Publication Nos. US 2020/0199231A1, and US 2020/0172627A1; bispecific CD3×SSTR 2 antibodies disclosed in International Application Publication No. WO 2018/005706A1; bispecific CD3×CD38 antibodies disclosed in International Application Publication Nos. WO 2015/149077A1 and WO 2020/018556A1, and U.S. Patent Application Publication Nos. US 2018/0305465A1 and US 2020/0102403A1; bispecific CD3×STEAP1 antibodies disclosed in Olivier Nolan-Stevaux (2020) Abstract at Proceedings of the Annual Meeting of the American Association for Cancer Research 2020; bispecific CD3×5T4 antibodies disclosed in International Application Publication No. WO 2013/041687A1, U.S. Patent Application Publication Nos. US 2017/0342160A1, US 20200277397A1; bispecific CD3×ENPP3 antibodies as descried in International Application Publication No. WO 2020/180726A1; bispecific CD3×MUC16 antibodies disclosed in International Application Publication Nos. WO 2018/067331A9 and WO 2019/246356A1; bispecific CD3×BCMA antibodies disclosed in International Application Publication Nos. WO 2013/072406A1, WO 2014/140248A1, WO 2016/166629A1, WO 2017/031104A1, WO 2017/134134A1, WO 2017/095267A1, WO 2019/220369A3, WO 2019/075359A1, WO 2019/226761A1, WO 2020/025596A1, WO 2020/191346A1, WO 2020018820A1, U.S. Patent Application Publication Nos. US 2013/0273055A1, US 2019/0263920A1; bispecific CD3×CD19 antibodies disclosed in International Application Publication Nos. WO 2012/055961A1, WO 2016/048938A1, WO 2017/087603A1, WO 2017/096368A1, WO 2018/188612A1, WO 2019/237081A1, WO 2020/048525A1, WO 2020/135335A1, U.S. Patent Application Publication Nos. US 2016/0326249A1, US 2020/0283523A1, US 2019/0284279A1, U.S. Pat. No. 9,315,567B2, U.S. Pat. No. 7,575,923B2, U.S. Pat. No. 7,635,472B2; bispecific CD3×GPRC5D antibodies disclosed in International Application Publication Nos. WO 2018/017786A3, WO 2019/220369A3; bispecific CD3× PSMA antibodies disclosed in U.S. Patent Application Publication No. US 2017/0320947A1; trispecific CD3×CD28× CD38 antibodies disclosed in U.S. Patent Application Publication No. US 2020/0140552A1; or other CD3 multispecific antibodies disclosed in International Application Publication Nos. WO 2016/086189A2, WO 2020/088608A1, WO2019191120A1, and WO 2016/105450A3, the contents of each of which is incorporated by reference herein in its entirety.

In some embodiments, the aforementioned multispecific (e.g., bispecific or trispecific) antigen-binding molecules that specifically bind CD3 and a tumor antigen may comprise an anti-CD3 antigen-binding molecule which binds to CD3 with a weak binding affinity such as exhibiting a $K_D$ of greater than about 40 nM, as measured by an in vitro affinity binding assay. The aforementioned bispecific antigen-binding molecules may comprise an anti-CD3 antigen-binding molecule which binds to CD3 and exhibits an EC50 of greater than about 100 nM, as measured by a FACS titration assay. The aforementioned bispecific antigen-binding molecules may comprise an anti-CD3 antigen-binding molecule which exhibits no measurable or observable binding to CD3, as measured by an in vitro affinity binding assay or a FACS titration assay, yet retains ability to activate human PBMC cells and/or induce cytotoxic activity on tumor antigen-expressing cell lines.

Therapeutic Formulation and Administration

In some aspects, provided herein are pharmaceutical compositions comprising a CD40 antagonist (e.g., a CD40 antagonist antibody, or an antigen binding fragment thereof) as described herein. In some aspects, provided herein are pharmaceutical compositions comprising a CD3 multispecific antigen-binding molecule as described herein. In some aspects, provided herein are pharmaceutical compositions in which a CD3 multispecific antigen-binding molecule described herein is co-formulated with a CD40 antagonist (e.g., a CD40 antagonist antibody, or an antigen binding fragment thereof) as described elsewhere herein.

The pharmaceutical compositions provided herein can be formulated with suitable carriers, excipients, and other agents that provide improved transfer, delivery, tolerance, and the like. A multitude of appropriate formulations can be found in the formulary known to all pharmaceutical chemists: Remington's Pharmaceutical Sciences, Mack Publishing Company, Easton, PA These formulations include, for example, powders, pastes, ointments, jellies, waxes, oils, lipids, lipid (cationic or anionic) containing vesicles (such as LIPOFECTIN™, Life Technologies, Carlsbad, CA), DNA conjugates, anhydrous absorption pastes, oil-in-water and water-in-oil emulsions, emulsions carbowax (polyethylene glycols of various molecular weights), semi-solid gels, and semi-solid mixtures containing carbowax. See also Powell et al. "Compendium of excipients for parenteral formulations" PDA (1998) J Pharm Sci Technol 52:238-311.

The dose of antigen-binding molecule administered to a patient may vary depending upon the age and the size of the patient, target disease, conditions, route of administration, and the like.

Various delivery systems are known and can be used to administer a pharmaceutical composition provided herein, e.g., encapsulation in liposomes, microparticles, microcapsules, recombinant cells capable of expressing the mutant viruses, receptor mediated endocytosis (see, e.g., Wu et al., 1987, J. Biol. Chem. 262:4429-4432). Methods of introduction include, but are not limited to, intradermal, intramuscular, intraperitoneal, intravenous, subcutaneous, intranasal, epidural, and oral routes. The composition may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local.

In some embodiments, a pharmaceutical composition provided herein can be delivered subcutaneously or intravenously with a standard needle and syringe. In addition, with respect to subcutaneous delivery, a pen delivery device readily has applications in delivering a pharmaceutical composition of the present invention. Such a pen delivery device can be reusable or disposable. A reusable pen delivery device generally utilizes a replaceable cartridge that contains a pharmaceutical composition. Once all of the pharmaceutical composition within the cartridge has been administered and the cartridge is empty, the empty cartridge can readily be discarded and replaced with a new cartridge that contains the pharmaceutical composition. The pen delivery device can then be reused. In a disposable pen delivery device, there is no replaceable cartridge. Rather, the disposable pen delivery device comes prefilled with the pharmaceutical composition held in a reservoir within the device. Once the reservoir is emptied of the pharmaceutical composition, the entire device is discarded.

Numerous reusable pen and autoinjector delivery devices have applications in the subcutaneous delivery of a pharmaceutical composition of the present invention. Examples include, but are not limited to AUTOPEN™ (Owen Mumford, Inc., Woodstock, UK), DISETRONIC™ pen (Disetronic Medical Systems, Bergdorf, Switzerland), HUMALOG MIX 75/25™ pen, HUMALOG™ pen, HUMALIN 70/30™ pen (Eli Lilly and Co., Indianapolis, IN), NOVOPEN™ I, II and III (Novo Nordisk, Copenhagen, Denmark), NOVOPEN JUNIOR™ (Novo Nordisk, Copenhagen, Denmark), BD™ pen (Becton Dickinson, Franklin Lakes, NJ), OPTIPEN™, OPTIPEN PRO™, OPTIPEN STARLET™, and OPTICLIK™ (sanofi-aventis, Frankfurt, Germany), to name only a few. Examples of disposable pen delivery devices having applications in subcutaneous delivery of a pharmaceutical composition of the present invention include, but are not limited to the SOLOSTAR™ pen (sanofi-aventis), the FLEXPEN™ (Novo Nordisk), and the KWIKPEN™ (Eli Lilly), the SURECLICK™ Autoinjector (Amgen, Thousand Oaks, CA), the PENLET™ (Haselmeier, Stuttgart, Germany), the EPIPEN (Dey, L. P.), and the HUMIRA™ Pen (Abbott Labs, Abbott Park IL), to name only a few.

In certain situations, the pharmaceutical composition can be delivered in a controlled release system. In one embodiment, a pump may be used (see Langer, supra; Sefton, 1987, CRC Crit. Ref. Biomed. Eng. 14:201). In another embodiment, polymeric materials can be used; see, Medical Applications of Controlled Release, Langer and Wise (eds.), 1974, CRC Pres., Boca Raton, Florida. In yet another embodiment, a controlled release system can be placed in proximity of the composition's target, thus requiring only a fraction of the systemic dose (see, e.g., Goodson, 1984, in Medical Applications of Controlled Release, supra, vol. 2, pp. 115-138). Other controlled release systems are discussed in the review by Langer, 1990, Science 249:1527-1533.

The injectable preparations may include dosage forms for intravenous, subcutaneous, intracutaneous and intramuscular injections, drip infusions, etc. These injectable preparations may be prepared by methods publicly known. For example, the injectable preparations may be prepared, e.g., by dissolving, suspending or emulsifying the antibody or its salt described above in a sterile aqueous medium or an oily medium conventionally used for injections. As the aqueous medium for injections, there are, for example, physiological saline, an isotonic solution containing glucose and other auxiliary agents, etc., which may be used in combination with an appropriate solubilizing agent such as an alcohol (e.g., ethanol), a polyalcohol (e.g., propylene glycol, polyethylene glycol), a nonionic surfactant [e.g., polysorbate 80, HCO-50 (polyoxyethylene (50 mol) adduct of hydrogenated castor oil)], etc. As the oily medium, there are employed, e.g., sesame oil, soybean oil, etc., which may be used in combination with a solubilizing agent such as benzyl benzoate, benzyl alcohol, etc. The injection thus prepared is preferably filled in an appropriate ampoule.

Advantageously, the pharmaceutical compositions for oral or parenteral use described above are prepared into dosage forms in a unit dose suited to fit a dose of the active ingredients. Such dosage forms in a unit dose include, for example, tablets, pills, capsules, injections (ampoules), suppositories, etc.

In some aspects, provided herein are pharmaceutical compositions comprising a CAR-T cell expressing a CD40 antagonist (e.g., a CD40 antagonist antibody, or an antigen binding fragment thereof) as described herein.

In certain embodiments, the CD40 antagonist expressing CAR-T cell populations may be administered either alone, or as a pharmaceutical composition in combination with pharmaceutically or physiologically acceptable carriers, diluents, excipients and/or with other components or cell populations. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions disclosed herein may be formulated for intravenous administration.

The administration of the CAR-T cell expressing a CD40 antagonist may be carried out in any convenient manner, including by injection, transfusion, or implantation. The compositions described herein may be administered to a patient subcutaneously, intradermally, intratumorally, intranodally, intramedullary, intramuscularly, by intravenous (i.v.) injection, or intraperitoneally. In some embodiments, the disclosed compositions are administered to a patient by intradermal or subcutaneous injection. In some embodiments, the disclosed compositions are administered Methods for Treating Cancers and/or Inhibiting Cytokine Release Syndrome In some aspects, the present invention includes methods for treating cancer and inhibiting cytokine release syndrome (CRS) in a subject. In some embodiments, the methods may comprise conjointly (e.g., concurrently or sequentially) administering (1) a CD40 antagonist or a CAR-T cell expressing a CD40 antagonist; and (2) a multispecific (e.g., bispecific or trispecific) antigen binding molecule comprising at least a first antigen-binding domain against CD3 and a second antigen-binding domain against a tumor antigen to a subject in need thereof. In some embodiments, the methods may comprise administering a pharmaceutical composition comprising (1) a CD40 antagonist or a CAR-T cell expressing a CD40 antagonist; and (2) a multispecific (e.g., bispecific or trispecific) antigen binding molecule comprising at least a first antigen-binding domain against CD3 and a second antigen-binding domain against a tumor antigen to a subject in need thereof. The therapeutic composition may comprise any of the CD40 antagonist antibodies and CD3 multispecific antigen-binding molecules as disclosed herein and a pharmaceutically acceptable carrier or diluent.

In some aspects, the present invention includes methods for inhibiting cytokine release syndrome (CSR), or reduce cytokine release caused by a multispecific antigen binding molecule comprising a first antigen-binding domain that specifically binds CD3 and a second antigen-binding domain that specifically binds a tumor antigen in a subject. The methods according to this aspect of the invention comprise administering a CD40 antagonist or a CAR-T cell expressing a CD40 antagonist to a subject in need thereof.

In some aspects, the methods described above further comprise diagnosing or identifying subjects susceptible for cytokine release syndrome or in need of reduction in cytokine release.

As used herein, the terms "treat", "treating", or the like, mean to alleviate symptoms, or eliminate the causation of symptoms either on a temporary or permanent basis. For example, "treating cancer" may mean to delay or inhibit tumor growth, to reduce tumor cell load or tumor burden, to promote tumor regression, to cause tumor shrinkage, necrosis and/or disappearance, to prevent tumor recurrence, and/or to increase duration of survival of the subject.

As used herein, the expression "a subject in need thereof" means a human or non-human mammal that exhibits one or more symptoms or indications of cancer and/or CRS, and/or who has been diagnosed with cancer and/or CRS, and who needs treatment for the same. In many embodiments, the term "subject" may be interchangeably used with the term "patient".

In some embodiments, cancers that may be treated by methods and compositions provided herein include, but are not limited to, cancer from the cervix, anus, vagina, vulva, penis, tongue base, larynx, tonsil, bladder, blood, bone, bone marrow, brain, breast, colon, esophagus, gastrointestine, gum, head, kidney, liver, lung, nasopharynx, neck, ovary, prostate, skin, non-melanoma skin cancer (NMSC), cutaneous squamous cell carcinoma (SCC), stomach, testis, tongue, or uterus. In addition, the cancer may specifically be of the following histological type, though it is not limited to these: neoplasm, malignant; carcinoma; carcinoma, undifferentiated; giant and spindle cell carcinoma; small cell carcinoma; papillary carcinoma; squamous cell carcinoma; lymphoepithelial carcinoma; basal cell carcinoma; pilomatrix carcinoma; transitional cell carcinoma; papillary transitional cell carcinoma; adenocarcinoma; gastrinoma, malignant; cholangiocarcinoma; hepatocellular carcinoma; combined hepatocellular carcinoma and cholangiocarcinoma; trabecular adenocarcinoma; adenoid cystic carcinoma; adenocarcinoma in adenomatous polyp; adenocarcinoma, familial polyposis coli; solid carcinoma; carcinoid tumor, malignant; branchiolo-alveolar adenocarcinoma; papillary adenocarcinoma; chromophobe carcinoma; acidophil carcinoma; oxyphilic adenocarcinoma; basophil carcinoma; clear cell adenocarcinoma; granular cell carcinoma; follicular adenocarcinoma; papillary and follicular adenocarcinoma; nonencapsulating sclerosing carcinoma; adrenal cortical carcinoma; endometrioid carcinoma; skin appendage carcinoma; apocrine adenocarcinoma; sebaceous adenocarcinoma; ceruminous adenocarcinoma; mucoepidermoid carcinoma; cystadenocarcinoma; papillary cystadenocarcinoma; papillary serous cystadenocarcinoma; mucinous cystadenocarcinoma; mucinous adenocarcinoma; signet ring cell carcinoma; infiltrating duct carcinoma; medullary carcinoma; lobular carcinoma; inflammatory carcinoma; mammary paget's disease; acinar cell carcinoma; adenosquamous carcinoma; adenocarcinoma w/squamous metaplasia; malignant thymoma; malignant ovarian stromal tumor; malignant thecoma; malignant granulosa cell tumor; and malignant roblastoma; sertoli cell carcinoma; malignant leydig cell tumor; malignant lipid cell tumor; malignant paraganglioma; malignant extra-mammary paraganglioma; pheochromocytoma; glomangiosarcoma; malignant melanoma; amelanotic melanoma; superficial spreading melanoma; malignant melanoma in giant pigmented nevus; epithelioid cell melanoma; malignant blue nevus; sarcoma; fibrosarcoma; malignant fibrous histiocytoma; myxosarcoma; liposarcoma; leiomyosarcoma; rhabdomyosarcoma; embryonal rhabdomyosarcoma; alveolar rhabdomyosarcoma; stromal sarcoma; malignant mixed tumor; mullerian mixed tumor; nephroblastoma; hepatoblastoma; carcinosarcoma; malignant mesenchymoma; malignant brenner tumor; malignant phyllodes tumor; synovial sarcoma; malignant mesothelioma; dysgerminoma; embryonal carcinoma; malignant teratoma; malignant struma ovarii; choriocarcinoma; malignant mesonephroma; hemangiosarcoma; malignant hemangioendothelioma; kaposi's sarcoma; malignant hemangiopericytoma; lymphangiosarcoma; osteosarcoma; juxtacortical osteosarcoma; chondrosarcoma; malignant chondroblastoma; mesenchymal chondrosarcoma; giant cell tumor of bone; ewing's sarcoma; malignant odontogenic tumor; ameloblastic odontosarcoma; malignant ameloblastoma; ameloblastic fibrosarcoma; malignant pinealoma; chordoma; malignant glioma; ependymoma; astrocytoma; protoplasmic astrocytoma; fibrillary astrocytoma; astroblastoma; glioblastoma; oligodendroglioma; oligodendroblastoma; primitive neuroectodermal; cerebellar sarcoma; ganglioneuroblastoma; neuroblastoma; retinoblastoma; olfactory neurogenic tumor; malignant meningioma; neurofibrosarcoma; malignant neurilemmoma; malignant granular cell tumor; malignant lymphoma; Hodgkin's disease; Hodgkin's lymphoma; paragranuloma; small lymphocytic malignant lymphoma; diffuse large cell malignant lymphoma; follicular malignant lymphoma; mycosis fungoides; other specified non-Hodgkin's lymphomas; malignant histiocytosis; multiple myeloma; mast cell sarcoma; immunoproliferative small intestinal disease; leukemia; lymphoid leukemia; plasma cell leukemia; erythroleukemia; lymphosarcoma cell leukemia; myeloid leukemia; basophilic leukemia; eosinophilic leukemia; monocytic leukemia; mast cell leukemia; megakaryoblastic leukemia; myeloid sarcoma; and hairy cell leukemia.

In some embodiments, cancers that may be treated by methods and compositions provided herein express the tumor antigen targeted by the CD3 multispecific antigen-binding molecules (e.g., a tumor with an expression of the tumor antigen as determined by flow cytometry on ≥20% of the tumor cells). In particular, the compositions and methods of the present invention may be used for the treatment, prevention and/or amelioration of any disease or disorder associated with or mediated by, e.g., CD20, PSMA, MUC16, STEAP2 or BCMA expression or activity or the proliferation of CD20+, PSMA+, MUC16+, STEAP2+, or BCMA+ cells. The mechanism of action by which the therapeutic methods of the invention are achieved include killing of the cells expressing such antigens in the presence of effector cells, for example, by CDC, apoptosis, ADCC, phagocytosis, or by a combination of two or more of these mechanisms.

In some embodiments, the CD3 multispecific antigen binding molecule used in the present compositions or methods is a bispecific anti-CD3×anti-PSMA antibody. The compositions or methods are useful for treating a PSMA-expressing cancer including prostate cancer, kidney cancer, bladder cancer, colorectal cancer, and gastric cancer. In some embodiments, the cancer is prostate cancer (e.g., castrate-resistant prostate cancer).

In some embodiments, the CD3 multispecific antigen binding molecule used in the present compositions or methods is a bispecific anti-CD3×anti-MUC16 antibody. The compositions or methods are useful for treating a MUC16-expressing cancer including ovarian cancer, breast cancer, pancreatic cancer, non-small-cell lung cancer, intrahepatic cholangiocarcinoma-mass forming type, adenocarcinoma of the uterine cervix, and adenocarcinoma of the gastric tract. In some embodiments, the cancer is ovarian cancer.

In some embodiments, the CD3 multispecific antigen binding molecule used in the present compositions or methods is a bispecific anti-CD3×anti-STEAP2 antibody. The compositions or methods are useful for treating a STEAP2-expressing cancer including prostate cancer, bladder cancer, cervical cancer, lung cancer, colon cancer, kidney cancer, breast cancer, pancreatic cancer, stomach cancer, uterine cancer, and ovarian cancer. In some embodiments, the cancer is prostate cancer (e.g., castrate-resistant prostate cancer).

In some embodiments, the CD3 multispecific antigen binding molecule used in the present compositions or methods is a bispecific anti-CD3×anti-BCMA antibody. The compositions or methods are useful for treating a BCMA-expressing cancer including multiple myeloma or other B-cell or plasma cell cancers, such as Waldenstrom's macroglobulinemia, Burkitt lymphoma, and diffuse large B-Cell lymphoma, Non-Hodgkin's lymphoma, chronic lymphocytic leukemia, follicular lymphoma, mantle cell lymphoma, marginal zone lymphoma, lymphoplasmacytic lymphoma, and Hodgkin's lymphoma. In some embodiments, the cancer is multiple myeloma.

In some embodiments, the CD3 multispecific antigen binding molecule used in the present compositions or methods is a bispecific anti-CD3×anti-CD20 antibody. The compositions or methods are useful for treating a CD20-expressing cancer including non-Hodgkin lymphoma, Hodgkin lymphoma, chronic lymphocytic leukemia, acute lymphoblastic leukemia, small lymphocytic lymphoma, diffuse large B-cell lymphoma, follicular lymphoma, mantle cell lymphoma, marginal zone lymphoma, Waldenstrom macroglobulinemia, primary mediastinal B-cell lymphoma, lymphoblastic lymphoma, or Burkitt lymphoma. In some embodiments, the cancer is follicular lymphoma. In some embodiments, the cancer is diffuse large B-cell lymphoma (DLBCL).

In some embodiments, the methods of the present invention are used in a subject (e.g., a cancer patient) with one or more symptoms or indications of cytokine release syndrome described herein, who has been diagnosed with cytokine release syndrome, and/or who are susceptible for cytokine release syndrome or in need of reduction in cytokine release.

In certain embodiments, the methods of the present invention are used in a subject that has been treated with certain cancer drugs (e.g., cancer immunotherapy, CAR-T cell therapy, or CD3 multispecific antigen binding molecules such as those described herein).

In some embodiments, for any of the methods disclosed herein, the subject treated, or the subject evaluated, is a subject to be treated or who has been treated with a cancer immunotherapy, e.g., a CD3 multispecific antigen binding molecule as described herein.

In some embodiments, the subject is at risk (e.g., at high risk) for developing CRS (e.g., severe CRS). In embodiments, the subject is at low risk (e.g., not at risk) for developing CRS (e.g., severe CRS). In some embodiments, the subject has CRS grade 0, CRS grade 1, CRS grade 2, or CRS grade 3. In some embodiments, the risk of a subject for developing CRS (e.g., severe CRS) is determined using an evaluation or prediction methods described herein.

In some embodiments, the methods provided herein treat, delay, or inhibit the growth of a tumor, or induce tumor cell death. In certain embodiments, the methods provided herein promote tumor regression. In certain embodiments, the methods provided herein reduce tumor cell load or to reduce tumor burden. In certain embodiments, the methods provided herein prevent tumor recurrence.

In some embodiments, the methods provided herein prevent, inhibit, alleviate, or treat CRS, e.g., by alleviating at least one symptom or indication associated with CRS, reducing CRS severity, or reducing cytokine release, etc. In some embodiments, the methods provided herein prevent, inhibit, alleviate, or treat CRS without negatively impacting the therapeutic benefits of the CD3 multispecific antigen binding molecule described herein.

In certain embodiments, the methods of the present invention comprise administering to a subject in need thereof a therapeutically effective amount of a CD40 antagonist or a CAR-T cell expressing a CD40 antagonist in combination with a therapeutically effective amount of a CD3 multispecific antigen binding molecule, wherein administration of a CD40 antagonist or a CAR-T cell expressing a CD40 antagonist leads to inhibition of CRS (e.g., inhibit or reduce at least one symptom, indication, or biomarker of CRS disclosed herein). In certain embodiments, CRS is inhibited by at least about 10%, about 20%, about 30%, about 40%, about 50%, about 60%, about 70% or about 80% as compared to a subject administered with a CD3 multispecific antigen binding molecule as monotherapy.

In certain embodiments, the administration of a CD40 antagonist or a CAR-T cell expressing a CD40 antagonist reduces cytokine release. In certain embodiments, levels of cytokines (e.g., TNFα, IL4, IL6, IL10, IL2, IFN-γ, IL-17A, IL13, or CD40L) is inhibited by at least about 10%, about 20%, about 30%, about 40%, about 50%, about 60%, about 70% or about 80% as compared to a subject administered with a CD3 multispecific antigen binding molecule as monotherapy.

In certain embodiments, the administration of a CD40 antagonist or a CAR-T cell expressing a CD40 antagonist in combination with a CD3 multispecific antigen binding molecule does not significantly reduce anti-tumor effects (e.g., inhibit or delay tumor growth, induce tumor regression, prevents tumor recurrence, and/or increases duration of survival, etc.) as compared to a subject administered with a CD3 multispecific antigen binding molecule as monotherapy. For example, the administration of a CD40 antagonist or a CAR-T cell expressing a CD40 antagonist in combination with a CD3 multispecific antigen binding molecule may reduce anti-tumor effects by less than about 40%, less than about 30%, less than about 20%, less than about 15%, less than about 10%, less than about 5%, less than about 1%, less than about 0.5%, or less than about 0.1%. as compared to a subject administered with a CD3 multispecific antigen binding molecule as monotherapy. In certain embodiments, the administration of a CD40 antagonist or a CAR-T cell expressing a CD40 antagonist does not affect anti-tumor efficacy of the CD3 multispecific antigen binding molecule.

In certain embodiments, the administration of a CD40 antagonist or a CAR-T cell expressing a CD40 antagonist in combination with a CD3 multispecific antigen binding molecule does not significantly reduce T cell (e.g., CD8+ T cell) activation, expansion, and/or cytotoxicity as compared to a subject administered with a CD3 multispecific antigen binding molecule as monotherapy. For example, the administration of a CD40 antagonist or a CAR-T cell expressing a CD40 antagonist in combination with a CD3 multispecific antigen binding molecule may reduce T cell (e.g., CD8+ T cell) activation, expansion, and/or cytotoxicity by less than about 40%, about 30%, about 20%, about 15%, about 10%, about 5%, about 1%, about 0.5%, or about 0.1%, as compared to a subject administered with a CD3 multispecific antigen binding molecule as monotherapy. In certain embodiments, the administration of a CD40 antagonist or a CAR-T cell expressing a CD40 antagonist does not affect T cell (e.g., CD8+ T cell) activation, expansion, and/or cytotoxicity induced by the CD3 multispecific antigen binding molecule.

In certain embodiments, the disclosed CD40 antagonist, CAR-T cell expressing CD40 antagonist, and/or CD3 multispecific antigen binding molecule are administered to a patient in conjunction with (e.g., before, simultaneously or following) any number of relevant treatment modalities, including but not limited to additional cancer or CRS treatments.

Exemplary CRS treatments include, e.g., IL-6 inhibitor or IL-6 receptor (IL-6R) inhibitors (e.g., tocilizumab or siltuximab), anti-TN-γ therapy, anti-sIL2Ra therapy, fever reducing medication such as acetaminophen, sgp130 blockers, vasoactive medications, corticosteroids, immunosuppressive agents, and mechanical ventilation. Exemplary vasoactive medications include but are not limited to angiotensin-11, endothelin-1, alpha adrenergic agonists, rostanoids, phosphodiesterase inhibitors, endothelin antagonists, inotropes (e.g., adrenaline, dobutamine, isoprenaline, ephedrine), vasopressors (e.g., noradrenaline, vasopressin, metaraminol, vasopressin, methylene blue), inodilators (e.g., milrinone, levosimendan), and dopamine. Exemplary vasopressors include but are not limited to norepinephrine, dopamine, phenylephrine, epinephrine, and vasopressin. Exemplary corticosteroids include but are not limited to dexamethasone, hydrocortisone, and methylprednisolone. Exemplary immunosuppressive agents include but are not limited to an inhibitor of TNFα or an inhibitor of IL-1. Assitonal exemplary therapies for CRS are disclosed in International Application WO2014011984, which is hereby incorporated by reference.

The additional therapeutically active component(s) may be administered just prior to, concurrent with, or shortly after the administration of an antigen-binding molecule of the present invention; (for purposes of the present disclosure, such administration regimens are considered the administration of an antigen-binding molecule "in combination with" an additional therapeutically active component).

Combined administration, as described above, may be simultaneous, separate, or sequential. For simultaneous administration, the agents may be administered as one composition or as separate compositions, as appropriate.

Administration Regimens

In certain embodiments, provided herein are methods comprising administering to a subject a CD40 antagonist (e.g., a CD40 antagonist antibody) or a CAR-T cell expressing a CD40 antagonist at a dosing frequency of about four times a week, twice a week, once a week, once every two weeks, once every three weeks, once every four weeks, once every five weeks, once every six weeks, once every eight weeks, once every twelve weeks, or less frequently so long as a therapeutic response is achieved.

In certain embodiments, provided herein are methods comprising administering to a subject a CD3 multispecific antigen binding molecule at a dosing frequency of about four times a week, twice a week, once a week, once every two weeks, once every three weeks, once every four weeks, once every five weeks, once every six weeks, once every eight weeks, once every twelve weeks, or less frequently so long as a therapeutic response is achieved.

In certain embodiments, the methods involve the administration of a CD40 antagonist (e.g., a CD40 antagonist antibody) or a CAR-T cell expressing a CD40 antagonist in combination with a CD3 multispecific antigen binding molecule at a dosing frequency of about four times a week, twice a week, once a week, once every two weeks, once every three weeks, once every four weeks, once every five weeks, once every six weeks, once every eight weeks, once every twelve weeks, or less frequently so long as a therapeutic response is achieved.

According to certain embodiments, multiple doses of a CD40 antagonist (e.g., a CD40 antagonist antibody) or a CAR-T cell expressing a CD40 antagonist in combination with a CD3 multispecific antigen binding molecule may be administered to a subject over a defined time course. The methods according to this aspect of the invention may comprise sequentially administering to a subject multiple doses of a CD40 antagonist (e.g., a CD40 antagonist antibody) or a CAR-T cell expressing a CD40 antagonist in combination with a CD3 multispecific antigen binding molecule. As used herein, "sequentially administering" means that each dose of an antigen-binding molecule is administered to the subject at a different point in time, e.g., on different days separated by a predetermined interval (e.g., hours, days, weeks or months). The present invention includes methods which comprise sequentially administering to the patient a single initial dose of a CD40 antagonist (e.g., a CD40 antagonist antibody) or a CAR-T cell expressing a CD40 antagonist, followed by one or more secondary doses of the CD40 antagonist (e.g., a CD40 antagonist antibody) or the CAR-T cell expressing a CD40 antagonist, and optionally followed by one or more tertiary doses of the CD40 antagonist (e.g., a CD40 antagonist antibody) or the CAR-T cell expressing a CD40 antagonist. In certain embodiments, the present invention further comprises sequentially administering to the patient a single initial dose of with a CD3 multispecific antigen binding molecule, followed by one or more secondary doses of the CD3 multispecific antigen binding molecule, and optionally followed by one or more tertiary doses of the CD3 multispecific antigen binding molecule.

The terms "initial dose," "secondary doses," and "tertiary doses," refer to the temporal sequence of administration of the antigen-binding molecule of the invention. Thus, the "initial dose" is the dose which is administered at the beginning of the treatment regimen (also referred to as the "baseline dose"); the "secondary doses" are the doses which are administered after the initial dose; and the "tertiary doses" are the doses which are administered after the secondary doses. The initial, secondary, and tertiary doses may all contain the same amount of the therapeutic agents described herein, but generally may differ from one another in terms of frequency of administration. In certain embodiments, however, the amount of an antigen-binding molecule contained in the initial, secondary and/or tertiary doses varies from one another (e.g., adjusted up or down as appropriate) during the course of treatment. In certain embodiments, two or more (e.g., 2, 3, 4, or 5) doses are administered at the beginning of the treatment regimen as "loading doses" followed by subsequent doses that are administered on a less frequent basis (e.g., "maintenance doses").

In one exemplary embodiment of the present invention, each secondary and/or tertiary dose is administered 1 to 26 (e.g., 1, 1½, 2, 2½, 3, 3½, 4, 4½, 5, 5½, 6, 6½, 7, 7½, 8, 8½, 9, 9½, 10, 10½, 11, 11½, 12, 12½, 13, 13½, 14, 14½, 15, 15½, 16, 16½, 17, 17½, 18, 18½, 19, 19½, 20, 20½, 21, 21½, 22, 22½, 23, 23½, 24, 24½, 25, 25½, 26, 26½, or more) weeks after the immediately preceding dose. The phrase "the immediately preceding dose," as used herein, means, in a sequence of multiple administrations, the dose of the therapeutic agents described herein which is administered to a patient prior to the administration of the very next dose in the sequence with no intervening doses.

The methods according to this aspect of the invention may comprise administering to a patient any number of secondary and/or tertiary doses of the therapeutic agents described herein. For example, in certain embodiments, only a single secondary dose is administered to the patient. In other embodiments, two or more (e.g., 2, 3, 4, 5, 6, 7, 8, or more) secondary doses are administered to the patient. Likewise, in certain embodiments, only a single tertiary dose is administered to the patient. In other embodiments, two or more (e.g., 2, 3, 4, 5, 6, 7, 8, or more) tertiary doses are administered to the patient.

In embodiments involving multiple secondary doses, each secondary dose may be administered at the same frequency as the other secondary doses. For example, each secondary dose may be administered to the patient 1 to 2 weeks after the immediately preceding dose. Similarly, in embodiments involving multiple tertiary doses, each tertiary dose may be administered at the same frequency as the other tertiary doses. For example, each tertiary dose may be administered to the patient 2 to 4 weeks after the immediately preceding dose. Alternatively, the frequency at which the secondary and/or tertiary doses are administered to a patient can vary over the course of the treatment regimen. The frequency of administration may also be adjusted during the course of treatment by a physician depending on the needs of the individual patient following clinical examination.

EXEMPLIFICATION

Example 1: CD40 Blockade Inhibited Cytokine Release Mediated by CD123×CD3 without Affecting T Cell Activation in 4 Day Assay with PBMC Enriched with Autologous B Cells Experimental Set-Up:
The effect of CD40 blockade on cytokine release was assessed in the assay with human PBMC enriched with autologous B cells and AML cell line MOLM13. B cells were isolated from human PBMC using EasySep human B cell isolation kit (StemCells cat #17954), labeled with CFSE, and plated in complete media (RPMI supplemented with 10% FBSm 100 U/mL penicillin, 100 µg/ml streptomycin, 292 µg/ml L-glutamine) with autologous PBMC and MOLM13 cells at the ratio (5:10:1). CD123×CD3(G) or one-arm CD3 control were added to the well in 10-fold titrations starting at 1 µg/ml. Anti-CD40 antibody (IgG1 mutant, REGN3794) was used at constant concentration of 5 µg/ml. Cells were incubated 4 days at 37° C. in complete media. Cytokines and T cell activations were assessed 4 days after the set-up. Cytokines were measured in the supernatants using LegendPlex human B cell panel (Biolegend Catalog #740527). For T cell activation assessment cells were stained with directly conjugated antibodies to CD2, CD25 and live/dead cell stain. T cell activation is reported as the percentage of live CD2+ cells expressing CD25.
Results:
Blocking CD40 with anti-CD40 antibody inhibited cytokine release mediated by bispecific CD123×CD3 antibody in 4 day in vitro assay with CD123+ tumor cells, human PBMC and enriched B cells without significantly affecting T cell activation (FIGS. 1A-1I).

Example 2: CD40 Blockade Inhibited Cytokine Release Mediated by CD3 Bispecific without Significantly Affecting T Cell Activation in 4 Day Assay with AML Cell Line and PBMC without Additional Autologous B Cells Experimental Set-Up:
The effect of CD40 blockade on cytokine release was assessed in the assay with human PBMC and AML cell line THP-1. Human PBMC were labeled with CFSE and THP-1 cells were labeled with Violet Cell trace. Labeled PBMC and THP-1 cells were plated in complete media at the ratio (10:1). CD123×CD3(G) or one-arm CD3 control were added to the well in 10-fold titrations starting at 1 µg/ml. Anti-CD40 antibody (IgG1 mutant, REGN3794) was used at constant concentration of 5 µg/ml. Cells were incubated 4 days at 37° C. in complete media. Cytokines and T cell activations were assessed 4 days after the set-up. Cytokines were measured in the supernatants using LegendPlex human B cell panel (Biolegend Catalog #740527). For T cell activation assessment cells were stained with directly conjugated antibodies to CD2, CD4, CD8, CD16, CD25 and live/dead cell stain. T cell activation is reported as the percentage of live CD2+CD16-CD8+ cells expressing CD25.
Results:
Blocking CD40 with anti-CD40 antibody inhibited cytokine release mediated by CD3 bispecific in 4 day in vitro assay with CD123+ tumor cells and human PBMC (no additional B cells) without significantly affecting T cell activation (FIGS. 2A-2E). In general, stronger cytokine release and more significant blockade of this release by anti-CD40 antibody were observed in assays including enriched B cells (FIGS. 1A-1H) as compared to those without (FIGS. 2A-2E).

Example 3: CD40 Blockade Inhibited Selected Cytokine Release Mediated by CD3 Bispecific without Significantly Affecting T Cell Activation and Target Killing in 4 Day Killing Assay with Prostate Cell Line and PBMC Experimental Set-Up:

The effect of CD40 blockade on cytokine release was assessed in the killing assay with human PBMC and prostate cell line 22Rv1. Human PBMC were labeled with CFSE and 22Rv1 cells were labeled with Violet Cell trace. Labeled PBMC and 22Rv1 cells were plated in complete media at the ratio (20:1). Steap2×CD3(G) or one-arm CD3 control were added to the well in 10-fold titrations starting at 1 µg/ml. Anti-CD40 antibody (IgG1 mutant, REGN3794) was used at constant concentration of 5 µg/ml. Cells were incubated 4 days at 37° C. in complete media. At the end of the culture, cytokine release, surviving target cells, and T cell activation were analyzed by flow cytometry. Cytokines were measured in the supernatants using LegendPlex human B cell panel (Biolegend Catalog #740527). For T cell activation and target cell killing assessment the cells were washed and stained with directly conjugated antibodies to CD2, CD4, CD8, CD16, CD25 and live/dead cell stain. T cell activation is reported as the percentage of live CD2+CD16-CD8+ cells expressing CD25. For the assessment of 22Rv1 survival, cells were gated on live violet-labeled population. The percentage of live population normalized to the untreated sample is reported.

Results:

Blocking CD40 with anti-CD40 antibody inhibited cytokine release mediated by CD3 bispecific in 4 day in vitro killing assay with STEAP2+ tumor cells and human PBMC without significantly affecting T cell activation and cytotoxicity (FIGS. 3A-3G). The extent of anti-CD40 mediated inhibition varied across cytokines (FIGS. 3C-3G).

Example 4: CD40 Blockade Reduced Cytokines in PBMC Treated with CD20×CD3 Bispecific (REGN1979)

Experimental Set-Up:

The effect of CD40 blockade on cytokine release was assessed in the killing assay with human PBMC and NHL cell line Ramos. Ramos cells were labeled with CFSE and mixed with human PBMC in complete media at the ratio (1:10). CD20×CD3 (REGN1979) or one-arm CD3 control were added to the well in 10-fold titrations starting at 10 µg/ml. Anti-CD40 antibody (IgG1 mutant, REGN3794) was used at constant concentration of 5 µg/ml. Cells were incubated 4 days at 37° C. in complete media. At the end of the culture, cytokine release, surviving target cells, and T cell activation were analyzed by flow cytometry. Cytokines were measured in the supernatants using LegendPlex human B cell panel (Biolegend Catalog #740527). For T cell activation and target cell killing assessment the cells were washed and stained with directly conjugated antibodies to CD2, CD4, CD8, CD16, CD25 and live/dead cell stain. T cell activation is reported as the percentage of live CD2+CD16-CD8+ cells expressing CD25. For the assessment of Ramos survival, absolute number of live Ramos cells per well was calculated using CountBright beads.

Figure 4A:
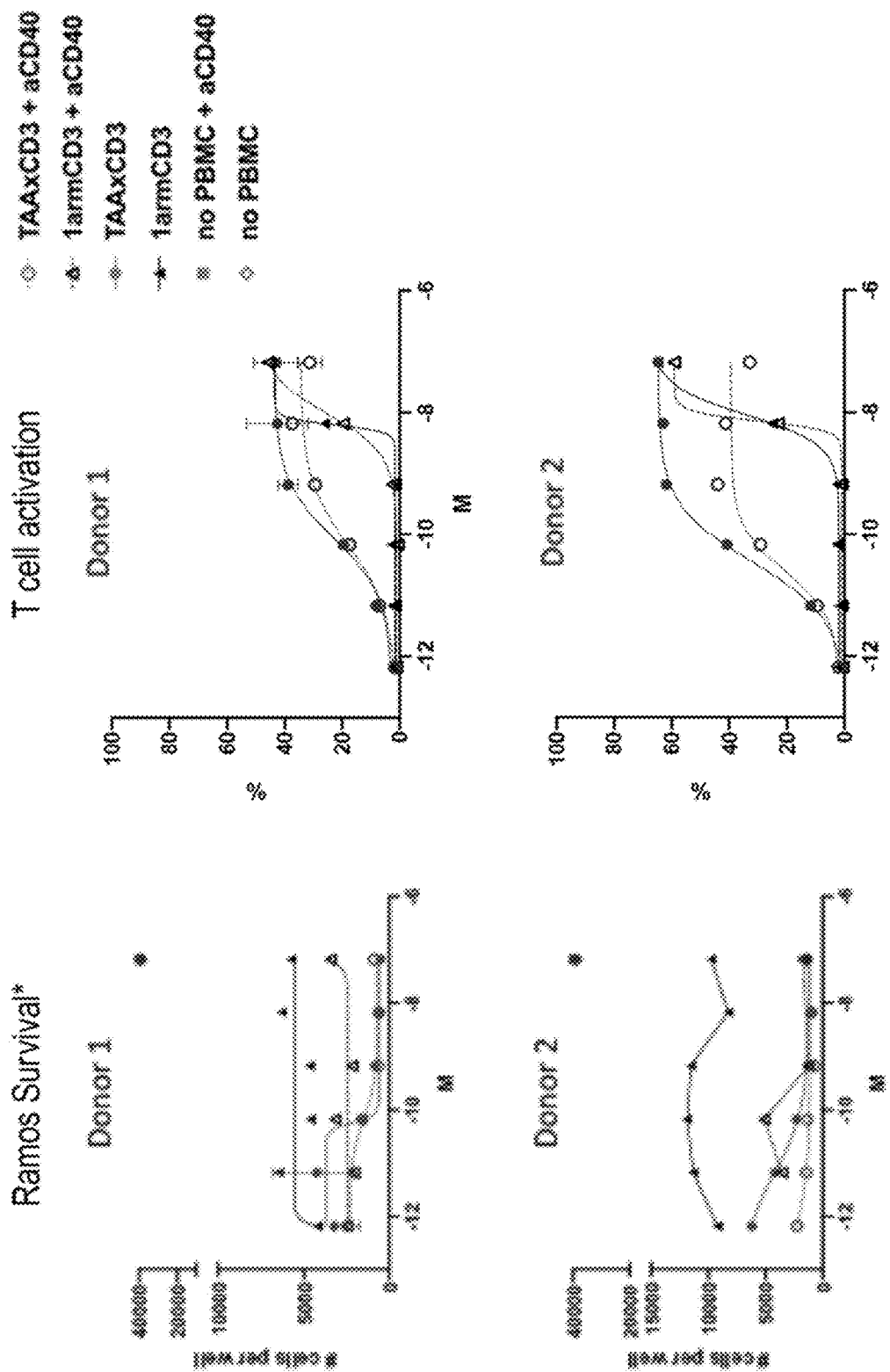
FIGS. 4A and 4B show that CD40 blockade reduced cytokines in PBMC treated with CD20×CD3 bispecific (REGN1979).
Figure 4B:
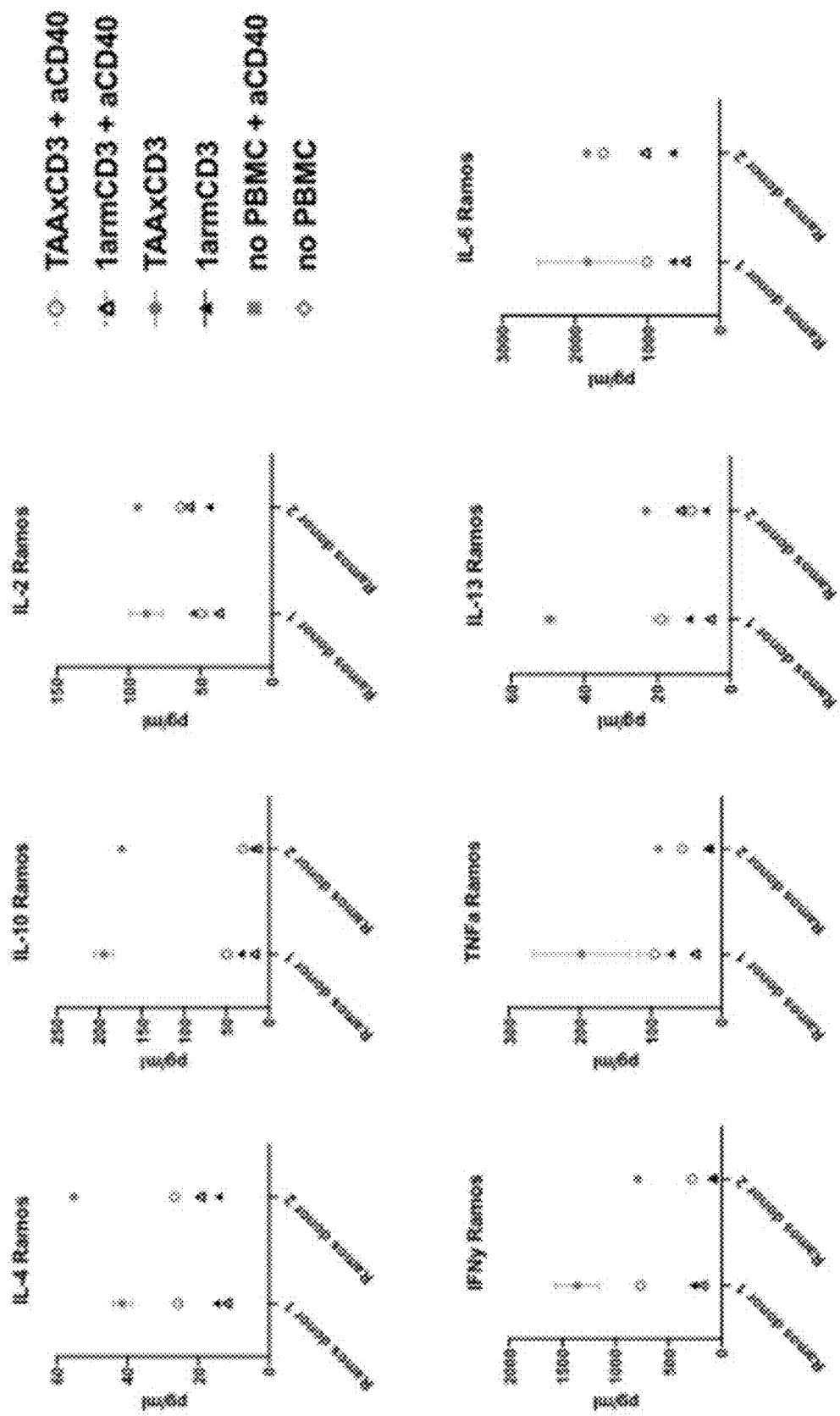

Results:

Blocking CD40 with anti-CD40 antibody inhibited cytokine release mediated by CD20×CD3 bispecific in 4 day in vitro killing assay with CD20+ tumor cells and human PBMC without negatively affecting cytotoxicity (FIGS. 4A-4B). The combination of CD20×CD3 (REGN1979)+ anti-CD40 antibody reduced T cell activation (~35% below CD20×CD3 (REGN1979) alone) in 1 of 2 donors tested (FIG. 4A).

INCORPORATION BY REFERENCE

All publications, patents, patent applications and sequence accession numbers mentioned herein are hereby incorporated by reference in their entirety as if each individual publication, patent or patent application was specifically and individually indicated to be incorporated by reference. In case of conflict, the present application, including any definitions herein, will control.

EQUIVALENTS

A number of embodiments of the invention have been described. Nevertheless, it will be understood that various modifications may be made without departing from the spirit and scope of the invention. Accordingly, other embodiments are within the scope of the following claims. Unless defined otherwise, all technical and scientific terms used herein have the same meanings as commonly understood by one of skill in the art to which the disclosed invention belongs.

Those skilled in the art will recognize, or be able to ascertain using no more than routine experimentation, many equivalents to the specific embodiments of the invention described herein. Such equivalents are intended to be encompassed by the following claims.

SEQUENCE LISTING (1194 sequences)

SEQ ID NO: 1 - protein, 122 aa, Artificial Sequence
  Description of Artificial Sequence: Synthetic polypeptide
EVQLVESGGGLVQPGRSLRLSCAASGFTFNDYAMHWVRQSPGKGLEWVSGIDWNGGSIDYADSVKGRFTISRDTAKNSLYLQMNSLKVEDTALYYCAKDIGHWNYIGGMDVWGQGTTVTVSS

SEQ ID NO: 2 - protein, 117 aa, Artificial Sequence
  Description of Artificial Sequence: Synthetic polypeptide
QVQLVESGGGLVKPGGSLRLSCAASGFTFSNYYMSWVRQAPGKGLEWISYISGRGSTIFYADSVKGRITISRDNAKNSLFLQMNSLRAEDTAVYFCVKDRGGYSPYWGQGTLVTVSS

SEQ ID NO: 3 - protein, 123 aa, Artificial Sequence
  Description of Artificial Sequence: Synthetic polypeptide
QVQLVESGGGVVQPGRSLRLSCAASGFTFSDHGMHWVRQAPGKGLEWVAVISYHGSNKHYADSVKGRFTISRDNSKNALYLQMNSLRPEDTAMYYCAKDGYDFWNGYSLFDYWGQGTLVTVSS

SEQ ID NO: 4 - protein, 123 aa, Artificial Sequence
  Description of Artificial Sequence: Synthetic polypeptide
QVQLVESGGGVVQPGRSLRLSCAASGFTFSDHAMHWVRQAPGKGLEWVAVISYHGTDKQYGDSVKGRFTISRDNSKNALYLQMNSLRPEDTAMYYCAKDGYDFWNAYSLFDYWGQGTLVTVSS

SEQ ID NO: 5 - protein, 123 aa, Artificial Sequence
  Description of Artificial Sequence: Synthetic polypeptide
EVQLVESGGGLVQPGGSLRLSCEASGFTFSNYAMSWVRQAPGKGLEWVSGMSGSGTYPYYADSVKGRFTISRDNSKNMLYLQMNSLRVKDTAVYYCAKDGVDTAMILDTFDLWGQGTMVTVSS

SEQ ID NO: 6 - protein, 120 aa, Artificial Sequence
  Description of Artificial Sequence: Synthetic polypeptide
QVQLVESGGGLVKPGGSLRLSCAASGFTFRDYSMSWIRQAPGKGLEWVSYVTFFNSAIYYADSVKGRFTISRDNAKNSLYLQMNSLRAEDTAVYYCAREREPIVGGFDYWGQGTLVTVSS

SEQ ID NO: 7 - protein, 120 aa, Artificial Sequence; identical to SEQ ID NO: 6
  Description of Artificial Sequence: Synthetic polypeptide

SEQ ID NO: 8 - protein, 129 aa, Artificial Sequence
  Description of Artificial Sequence: Synthetic polypeptide
EVQLVESGGGLEQPGRSLRLSCTASGFAFGDHTMSWVRQAPGKGLEWVGFIRSRAYGGTTEYAASVKGRFTISRDDSKSIAYLQMDSLKTEDTAVYYCTSGGYDSSLHYYYYYHGMDVWGRGTTVTVSS

SEQ ID NO: 9 - protein, 129 aa, Artificial Sequence; identical to SEQ ID NO: 8
  Description of Artificial Sequence: Synthetic polypeptide

SEQ ID NO: 10 - protein, 129 aa, Artificial Sequence
  Description of Artificial Sequence: Synthetic polypeptide
EVQLVESGGGLVQPGRSLRLSCTGSGLTFGDYGMSWVRQAPGKGLEWVGFIRSKGYGGTTEYAASVKGRFTISRDDSKSTAYLQMNSLKTEDTAVYYCTSGGYDSSVHYYYYYYAMDVWGQGTTVTVSS

SEQ ID NO: 11 - protein, 121 aa, Artificial Sequence
  Description of Artificial Sequence: Synthetic polypeptide
QVQLVESGGGVVQPGRSLRLSCVASGFTFSNYGIHWVRQAPGKGLEWVAVISDDGSFKFYADSVKGRFTISRDNSKNTLYLQMNSLRVEDSAVYHCAKWQHNWNDGGFDYWGQGTLVTVSS

SEQ ID NO: 12 - protein, 113 aa, Artificial Sequence
  Description of Artificial Sequence: Synthetic polypeptide
EVQLVESGGALVQPGGSLRLSCAASGFTFSSYAMHWVRQAPGKGLEFVSTISYNGGTTYYADSVKGRFTVSRDNSKNTVFLRMGSLRTEDMAVYYCARAAAPWGQGTLVTVSS

SEQ ID NO: 13 - protein, 120 aa, Artificial Sequence
  Description of Artificial Sequence: Synthetic polypeptide
QVQLVQSGAEVKKPGASVKVSCKAFGYTLTGYYIHWVRQAPGQGLEWMGWINPNNGGTNYAQKFQGRVTMTRDKSISTAYMELSRLRSDDTAVYYCARSLELLPDGMDVWGQGTTVTVSS

SEQ ID NO: 14 - protein, 114 aa, Artificial Sequence
  Description of Artificial Sequence: Synthetic polypeptide
QVQLVESGGGVVQPGRSLKLSCAASGFTFSSYSLHWVRQAPGKGLEWVALISYDGSNTYYADSVKGRFTISRDNSNNTLFLQMTSLRAEDTAIYYCARSIATSWGQGVLVTVSS

SEQ ID NO: 15 - protein, 119 aa, Artificial Sequence
  Description of Artificial Sequence: Synthetic polypeptide
QVQLQESGPGLVKPSETLSLTCTVSGGAINTYYWSWIRQPPGKGLEWIGYIYYRGNTNYNPSLRSRVTISVDTSKNQFFLKLRSVTVADSAVYFCARGWNYRAEYFQHWGQGTVVTVSS

SEQ ID NO: 16 - protein, 118 aa, Artificial Sequence
  Description of Artificial Sequence: Synthetic polypeptide
QVQLQESGPGLVKPSETLSLTCTVSGGSISSHYWSWIRQPPGKGLEWIGYIYYSGSTNYNPSLKSRVTISVDRSKNRFSLKLSSVTAADTAVYYCARTFYDDYAFDYWGQGTLVTVSS

SEQ ID NO: 17 - protein, 118 aa, Artificial Sequence
  Description of Artificial Sequence: Synthetic polypeptide
QVQLQESGPGLVKPSETLSLTCTVSGGSISSYYWSWIRQPPGKGLEWIGYVDYSGSTDYNPSLKSRVTISVDTSKNQFSLRLNSVTAADTAVYYCARGFNWNYEFDYWGQGTLVTVSS

SEQ ID NO: 18 - protein, 117 aa, Artificial Sequence
  Description of Artificial Sequence: Synthetic polypeptide
QMQLQESGPGLVKPSETLSLTCTVSGGSISSYYWNWIRQPPGKGLEWIGYIYYSGNNFNPSLKSRVTISVDTSKNQFSLKLSSVTAADTAVYYCARAFHWNYEFDYWGQGTLVTVSS

SEQ ID NO: 19 - protein, 122 aa, Artificial Sequence
  Description of Artificial Sequence: Synthetic polypeptide
EVQLVESGGGLVQPGRSLRLSCAASGFTFDEYAMHWVRQAPGKGLEWVSSISWNQGNIDYADSVKGRFTISRDNAKGSLYLQMNSLRAEDTALYYCVKDRSSHYYYYGMDVWGQGTTVTVSS

SEQ ID NO: 20 - protein, 119 aa, Artificial Sequence
  Description of Artificial Sequence: Synthetic polypeptide
QVQLQQWGAGLLKPSETLSLTCAVYGGSFSGFYWSWIRQSPGKGLEWIGEINRGGSTNSNPSLKSRVTMSLDTSKTQFSLKLRSVTAADTAIYYCARSLELDSDGFDIWGQGTMVTVSS

SEQ ID NO: 21 - protein, 119 aa, Artificial Sequence
  Description of Artificial Sequence: Synthetic polypeptide
QMQLQQWGAGLLKPSETLSLTCAVYGGSLSGYYWNWIRQSPGKGLEWIGKINHSGSTNYNPSLKSRVTISVDRSRIQFSLKLSSVTAADTAVYYCARALELLTDGMDVWGQGTTVTVSS

SEQ ID NO: 22 - protein, 122 aa, Artificial Sequence
  Description of Artificial Sequence: Synthetic polypeptide
EVQLVESGGGLVQPGRSLRLSCAASGFTFDDYAMHWVRQAPGRGLEWVSSISWNSDNIDYADSVKGRFTIARDSAKNSLYLQMNSLRAEDTALYYCVKDRSSHYYYYGMDVWGQGTTVTVSS

SEQ ID NO: 23 - protein, 119 aa, Artificial Sequence; identical to SEQ ID NO: 21
  Description of Artificial Sequence: Synthetic polypeptide

SEQ ID NO: 24 - protein, 121 aa, Artificial Sequence
  Description of Artificial Sequence: Synthetic polypeptide
EVQLVESGGGLVQAGGSLRLSCAASGFTFSYHEMNWVRQAPGKGLEWVSYIGSRGTTKHYADPVKGRFTISRDNAKNSLYLQMNSLRAEDTAVYYCASEVGSILGYSMDVWGQGTTVTVSS

SEQ ID NO: 25 - protein, 125 aa, Artificial Sequence
  Description of Artificial Sequence: Synthetic polypeptide
QVQLVQSGAEVKKPGASVKVSCKASGYTFTSSDINWVRQATGQGLEWVGWMNPNYGYTGSARKFQDRVTMTRNTSLSTAYLELHSLRSEDTAVYYCARVTYCSSVTSCFRPFTYWGQGTLVTVSA

SEQ ID NO: 26 - protein, 115 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARKKLVFDYWGQGTLVTVSS

SEQ ID NO: 27 - protein, 118 aa, Artificial Sequence
  Description of Artificial Sequence: Synthetic polypeptide
QVQLQQWGAGLLKPSETLSLTCAVYGGSFSDYYWSWIRQPPGKGLEWIGEINHRGKTNYNPSLKSRVSISVDPSKNQFSLKLSSVTAADTAVYYCARQGWNYAIFDYWGQGILVPVSS

SEQ ID NO: 28 - protein, 118 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGKTTYSPSLKSRVTISVDTSKSQFSLKLSSVTAADTAVYYCARQGLNYAIFDYWGQGTLVTVSS

SEQ ID NO: 29 - protein, 118 aa, Artificial Sequence
  Description of Artificial Sequence: Synthetic polypeptide
QVQLQQWGAGLLKPSETLSLTCAVYGGSFSGFYWSWIRQPPGKGLEWIGEINHSGSAKYNPSLKNRVIISIDTSKNQFSLKLDSVTAADTAVYNCARQGWNFAIFDYWGQGTLVDVSS

SEQ ID NO: 30 - protein, 8 aa, Artificial Sequence
  Description of Artificial Sequence: Synthetic peptide
GFTFNDYA

SEQ ID NO: 31 - protein, 8 aa, Artificial Sequence
  Description of Artificial Sequence: Synthetic peptide
GFTFSNYY

SEQ ID NO: 32 - protein, 8 aa, Artificial Sequence
  Description of Artificial Sequence: Synthetic peptide
GFTFSDHG

SEQ ID NO: 33 - protein, 8 aa, Artificial Sequence
  Description of Artificial Sequence: Synthetic peptide
GFTFSDHA

SEQ ID NO: 34 - protein, 8 aa, Artificial Sequence
  Description of Artificial Sequence: Synthetic peptide
GFTFSNYA

SEQ ID NO: 35 - protein, 8 aa, Artificial Sequence
  Description of Artificial Sequence: Synthetic peptide
GFTFRDYS

SEQ ID NO: 36 - protein, 8 aa, Artificial Sequence
  Description of Artificial Sequence: Synthetic peptide
GFTFRDYS

SEQ ID NO: 37 - protein, 8 aa, Artificial Sequence
  Description of Artificial Sequence: Synthetic peptide
GFAFGDHT

SEQ ID NO: 38 - protein, 8 aa, Artificial Sequence
  Description of Artificial Sequence: Synthetic peptide
GFAFGDHT

SEQ ID NO: 39 - protein, 8 aa, Artificial Sequence
  Description of Artificial Sequence: Synthetic peptide
GLTFGDYG

SEQ ID NO: 40 - protein, 8 aa, Artificial Sequence
  Description of Artificial Sequence: Synthetic peptide
GFTFSNYG

SEQ ID NO: 41 - protein, 8 aa, Artificial Sequence
  Description of Artificial Sequence: Synthetic peptide
GFTFSSYA

SEQ ID NO: 42 - protein, 8 aa, Artificial Sequence
  Description of Artificial Sequence: Synthetic peptide
GYTLTGYY

SEQ ID NO: 43 - protein, 8 aa, Artificial Sequence
  Description of Artificial Sequence: Synthetic peptide
GFTFSSYS

SEQ ID NO: 44 - protein, 8 aa, Artificial Sequence
  Description of Artificial Sequence: Synthetic peptide
GGAINTYY

SEQ ID NO: 45 - protein, 8 aa, Artificial Sequence
  Description of Artificial Sequence: Synthetic peptide
GGSISSHY

SEQ ID NO: 46 - protein, 8 aa, Artificial Sequence
  Description of Artificial Sequence: Synthetic peptide
GGSISSYY

SEQ ID NO: 47 - protein, 8 aa, Artificial Sequence
  Description of Artificial Sequence: Synthetic peptide
GGSISSYY

SEQ ID NO: 48 - protein, 8 aa, Artificial Sequence
  Description of Artificial Sequence: Synthetic peptide
GFTFDEYA

SEQ ID NO: 49 - protein, 8 aa, Artificial Sequence
  Description of Artificial Sequence: Synthetic peptide
GGSFSGFY

SEQ ID NO: 50 - protein, 8 aa, Artificial Sequence
  Description of Artificial Sequence: Synthetic peptide
GGSLSGYY

SEQ ID NO: 51 - protein, 8 aa, Artificial Sequence
  Description of Artificial Sequence: Synthetic peptide
GFTFDDYA

SEQ ID NO: 52 - protein, 8 aa, Artificial Sequence
  Description of Artificial Sequence: Synthetic peptide
GGSLSGYY

SEQ ID NO: 53 - protein, 8 aa, Artificial Sequence
  Description of Artificial Sequence: Synthetic peptide
GFTFSYHE

SEQ ID NO: 54 - protein, 8 aa, Artificial Sequence
  Description of Artificial Sequence: Synthetic peptide
GYTFTSSD

SEQ ID NO: 55 - protein, 8 aa, Artificial Sequence
  Description of Artificial Sequence: Synthetic peptide
GGSISSYY

SEQ ID NO: 56 - protein, 8 aa, Artificial Sequence
  Description of Artificial Sequence: Synthetic peptide
GGSFSDYY

SEQ ID NO: 57 - protein, 8 aa, Artificial Sequence
  Description of Artificial Sequence: Synthetic peptide
GGSFSGYY

SEQ ID NO: 58 - protein, 8 aa, Artificial Sequence
  Description of Artificial Sequence: Synthetic peptide
GGSFSGFY

SEQ ID NO: 59 - protein, 8 aa, Artificial Sequence
  Description of Artificial Sequence: Synthetic peptide
IDWNGGSI

SEQ ID NO: 60 - protein, 8 aa, Artificial Sequence
  Description of Artificial Sequence: Synthetic peptide
ISGRGSTI

SEQ ID NO: 61 - protein, 8 aa, Artificial Sequence
  Description of Artificial Sequence: Synthetic peptide
ISYHGSNK

SEQ ID NO: 62 - protein, 8 aa, Artificial Sequence
  Description of Artificial Sequence: Synthetic peptide
ISYHGTDK

SEQ ID NO: 63 - protein, 8 aa, Artificial Sequence
  Description of Artificial Sequence: Synthetic peptide
MSGSGTYP

SEQ ID NO: 64 - protein, 8 aa, Artificial Sequence
  Description of Artificial Sequence: Synthetic peptide
VTFFNSAI

SEQ ID NO: 65 - protein, 8 aa, Artificial Sequence
  Description of Artificial Sequence: Synthetic peptide
VTFFNSAI

SEQ ID NO: 66 - protein, 10 aa, Artificial Sequence
  Description of Artificial Sequence: Synthetic peptide
IRSRAYGGTT

SEQ ID NO: 67 - protein, 10 aa, Artificial Sequence
  Description of Artificial Sequence: Synthetic peptide
IRSRAYGGTT

SEQ ID NO: 68 - protein, 10 aa, Artificial Sequence
  Description of Artificial Sequence: Synthetic peptide
IRSKGYGGTT

SEQ ID NO: 69 - protein, 8 aa, Artificial Sequence
  Description of Artificial Sequence: Synthetic peptide
ISDDGSFK

SEQ ID NO: 70 - protein, 8 aa, Artificial Sequence
  Description of Artificial Sequence: Synthetic peptide
ISYNGGTT

SEQ ID NO: 71 - protein, 8 aa, Artificial Sequence
  Description of Artificial Sequence: Synthetic peptide
INPNNGGT

SEQ ID NO: 72 - protein, 8 aa, Artificial Sequence
  Description of Artificial Sequence: Synthetic peptide
ISYDGSNT

SEQ ID NO: 73 - protein, 7 aa, Artificial Sequence
  Description of Artificial Sequence: Synthetic peptide
IYYRGNT

SEQ ID NO: 74 - protein, 7 aa, Artificial Sequence
  Description of Artificial Sequence: Synthetic peptide
IYYSGST

SEQ ID NO: 75 - protein, 7 aa, Artificial Sequence
  Description of Artificial Sequence: Synthetic peptide
VDYSGST

SEQ ID NO: 76 - protein, 6 aa, Artificial Sequence
  Description of Artificial Sequence: Synthetic peptide
IYYSGN

SEQ ID NO: 77 - protein, 8 aa, Artificial Sequence
  Description of Artificial Sequence: Synthetic peptide
ISWNQGNI

SEQ ID NO: 78 - protein, 7 aa, Artificial Sequence
  Description of Artificial Sequence: Synthetic peptide
INRGGST

SEQ ID NO: 79 - protein, 7 aa, Artificial Sequence
  Description of Artificial Sequence: Synthetic peptide
INHSGST

SEQ ID NO: 80 - protein, 8 aa, Artificial Sequence
  Description of Artificial Sequence: Synthetic peptide
ISWNSDNI

SEQ ID NO: 81 - protein, 7 aa, Artificial Sequence
  Description of Artificial Sequence: Synthetic peptide
INHSGST

SEQ ID NO: 82 - protein, 8 aa, Artificial Sequence
  Description of Artificial Sequence: Synthetic peptide
IGSRGTTK

SEQ ID NO: 83 - protein, 8 aa, Artificial Sequence
  Description of Artificial Sequence: Synthetic peptide
MNPNYGYT

SEQ ID NO: 84 - protein, 7 aa, Artificial Sequence
  Description of Artificial Sequence: Synthetic peptide
IYYSGST

SEQ ID NO: 85 - protein, 7 aa, Artificial Sequence
  Description of Artificial Sequence: Synthetic peptide
INHRGKT

SEQ ID NO: 86 - protein, 7 aa, Artificial Sequence
  Description of Artificial Sequence: Synthetic peptide
INHSGKT

SEQ ID NO: 87 - protein, 7 aa, Artificial Sequence
  Description of Artificial Sequence: Synthetic peptide
INHSGSA

SEQ ID NO: 88 - protein, 15 aa, Artificial Sequence
  Description of Artificial Sequence: Synthetic peptide
AKDIGHWNYIGGMDV

SEQ ID NO: 89 - protein, 10 aa, Artificial Sequence
  Description of Artificial Sequence: Synthetic peptide
VKDRGGYSPY

SEQ ID NO: 90 - protein, 16 aa, Artificial Sequence
  Description of Artificial Sequence: Synthetic peptide
AKDGYDFWNGYSLFDY

SEQ ID NO: 91 - protein, 16 aa, Artificial Sequence
  Description of Artificial Sequence: Synthetic peptide
AKDGYDFWNAYSLFDY

SEQ ID NO: 92 - protein, 16 aa, Artificial Sequence
  Description of Artificial Sequence: Synthetic peptide
AKDGVDTAMILDTFDL

SEQ ID NO: 93 - protein, 13 aa, Artificial Sequence
  Description of Artificial Sequence: Synthetic peptide
AREREPIVGGFDY

SEQ ID NO: 94 - protein, 13 aa, Artificial Sequence
  Description of Artificial Sequence: Synthetic peptide
AREREPIVGGFDY

SEQ ID NO: 95 - protein, 20 aa, Artificial Sequence
  Description of Artificial Sequence: Synthetic peptide
TSGGYDSSLHYYYYYHGMDV

SEQ ID NO: 96 - protein, 20 aa, Artificial Sequence
  Description of Artificial Sequence: Synthetic peptide
TSGGYDSSLHYYYYYHGMDV

SEQ ID NO: 97 - protein, 20 aa, Artificial Sequence
  Description of Artificial Sequence: Synthetic peptide
TSGGYDSSVHYYYYYYAMDV

SEQ ID NO: 98 - protein, 14 aa, Artificial Sequence
  Description of Artificial Sequence: Synthetic peptide
AKWQHNWNDGGFDY

SEQ ID NO: 99 - protein, 6 aa, Artificial Sequence
  Description of Artificial Sequence: Synthetic peptide
ARAAAP

SEQ ID NO: 100 - protein, 13 aa, Artificial Sequence
  Description of Artificial Sequence: Synthetic peptide
ARSLELLPDGMDV

SEQ ID NO: 101 - protein, 7 aa, Artificial Sequence
  Description of Artificial Sequence: Synthetic peptide
ARSIATS

SEQ ID NO: 102 - protein, 13 aa, Artificial Sequence
  Description of Artificial Sequence: Synthetic peptide
ARGWNYRAEYFQH

SEQ ID NO: 103 - protein, 12 aa, Artificial Sequence
  Description of Artificial Sequence: Synthetic peptide
ARTFYDDYAFDY

SEQ ID NO: 104 - protein, 12 aa, Artificial Sequence
  Description of Artificial Sequence: Synthetic peptide
ARGFNWNYEFDY

SEQ ID NO: 105 - protein, 12 aa, Artificial Sequence
  Description of Artificial Sequence: Synthetic peptide
ARAFHWNYEFDY

SEQ ID NO: 106 - protein, 15 aa, Artificial Sequence
  Description of Artificial Sequence: Synthetic peptide
VKDRSSHYYYYGMDV

SEQ ID NO: 107 - protein, 13 aa, Artificial Sequence
  Description of Artificial Sequence: Synthetic peptide
ARSLELDSDGFDI

SEQ ID NO: 108 - protein, 13 aa, Artificial Sequence
  Description of Artificial Sequence: Synthetic peptide
ARALELLTDGMDV

SEQ ID NO: 109 - protein, 15 aa, Artificial Sequence
  Description of Artificial Sequence: Synthetic peptide
VKDRSSHYYYYGMDV

SEQ ID NO: 110 - protein, 13 aa, Artificial Sequence
  Description of Artificial Sequence: Synthetic peptide
ARALELLTDGMDV

SEQ ID NO: 111 - protein, 14 aa, Artificial Sequence
  Description of Artificial Sequence: Synthetic peptide
ASEVGSILGYSMDV

SEQ ID NO: 112 - protein, 18 aa, Artificial Sequence
  Description of Artificial Sequence: Synthetic peptide
ARVTYCSSVTSCFRPFTY

SEQ ID NO: 113 - protein, 9 aa, Artificial Sequence
  Description of Artificial Sequence: Synthetic peptide
ARKKLVFDY

SEQ ID NO: 114 - protein, 12 aa, Artificial Sequence
  Description of Artificial Sequence: Synthetic peptide
ARQGWNYAIFDY

SEQ ID NO: 115 - protein, 12 aa, Artificial Sequence
  Description of Artificial Sequence: Synthetic peptide
ARQGLNYAIFDY

SEQ ID NO: 116 - protein, 12 aa, Artificial Sequence
  Description of Artificial Sequence: Synthetic peptide
ARQGWNFAIFDY

SEQ ID NO: 117 - protein, 108 aa, Artificial Sequence
  Description of Artificial Sequence: Synthetic polypeptide
DIQMTQSPSSLSASVGDRVTITCRASQSINIYLNWYQQKPGKAPKFLIYAASSLQTGVPSRFSGSGSGTDFTLTISSLEPEDFATYYCQHSYSTPPITFGQGTRLEIK

SEQ ID NO: 118 - protein, 108 aa, Artificial Sequence
  Description of Artificial Sequence: Synthetic polypeptide
DIQMTQSPSSLSASVGDRVTITCRASQSISTYLNWYQQKPGKAPKLLIYTASSLQSGVPSRFSGSGSGTDFTLTISSLQPEDFATYYCQQSYSTPPITFGQGTRLEIK

SEQ ID NO: 119 - protein, 108 aa, Artificial Sequence
  Description of Artificial Sequence: Synthetic polypeptide
DIQMTQSPSSLSASVGDRVTITCRASQSISNYLNWYQQKPGKAPKLLIYTASNLLSGVPSRFSGSGSGTDFTLTISSLQPEDFATYYCQQSYSTPPITFGQGTKLEIK

SEQ ID NO: 120 - protein, 108 aa, Artificial Sequence
  Description of Artificial Sequence: Synthetic polypeptide
DIQMTQSPSSLSASVGDRVTITCRASQSISNYLNWYQQKPGKAPKLLIYTASSLLSGVPSRFSGSGSGTDFTLTISSLQPEDFATYYCQQSYSTPPITFGQGTRLEIK

SEQ ID NO: 121 - protein, 108 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPITFGQGTKLEIK

SEQ ID NO: 122 - protein, 108 aa, Artificial Sequence
  Description of Artificial Sequence: Synthetic polypeptide
DIQMTQSPSSLSASVGDRVTITCRASQSINSYLNWYQQKPGKAPKLLIYAASSLQGGVPSRFSGGGSGTDFTLTITSLQPEDFATFYCQQSYSSPPITFGQGTRLEIK

SEQ ID NO: 123 - protein, 108 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPITFGQGTRLEIK

SEQ ID NO: 124 - protein, 108 aa, Artificial Sequence
  Description of Artificial Sequence: Synthetic polypeptide
EIVLTQSPGTLSLSPGERATLSCRASQSITSSYLAWYQQRPGQAPRLLIYGASSRATGIPDRFSGSGSGTDFTLTISRLEPEDFAVYYCQQYGSSPWTFGQGTKVEIK

SEQ ID NO: 125 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 126 - protein, 108 aa, Artificial Sequence
  Description of Artificial Sequence: Synthetic polypeptide
EIVLTQSPGTLSLSPGERATLSCRASQTVSSSYLAWYQQKPGQAPRLLIYGASSRATGIPDRFSGSGSGTDFTLTISRLEPEDFAVYYCQQYGSSPWTFGQGTKVEIK

SEQ ID NO: 127 - protein, 108 aa, Artificial Sequence
  Description of Artificial Sequence: Synthetic polypeptide
EIVLTQSPDTLSLSPGERATLSCRASQSLSSNYLAWYRQKPGQAPRLLIYGISSRATGIPDRFSGSGSGTDFTLTISRLEPEDFAVYYCQQYGSSPWTFGQGTKVEIK

SEQ ID NO: 128 - protein, 108 aa, Artificial Sequence
  Description of Artificial Sequence: Synthetic polypeptide
EIVLTQSPDTLSLSPGERATLSCRASQSVSNRYLAWYQQKPGQAPRLLIYGASSRATGIPDRFSGSGSGTDFTLTISRLEPEDFAVYYCHQYGSSPWTFGQGTKVEIK

SEQ ID NO: 129 - protein, 108 aa, Artificial Sequence; identical to SEQ ID NO: 125
  Description of Artificial Sequence: Synthetic polypeptide

SEQ ID NO: 130 - protein, 108 aa, Artificial Sequence
  Description of Artificial Sequence: Synthetic polypeptide
EIVLTQSPGTLSLSPGERATLSCRASQSVSNRYLAWHQQKPGQAPRLLIYGASSRATGIPDRFSGSGSGTDFTLTISRLEPEDFAVYYCQQYGSSPWAFGQGTKVEIK

SEQ ID NO: 131 - protein, 108 aa, Artificial Sequence; identical to SEQ ID NO: 123
  Description of Artificial Sequence: Synthetic polypeptide

SEQ ID NO: 132 - protein, 108 aa, Artificial Sequence
  Description of Artificial Sequence: Synthetic polypeptide
EIVLTQSPGTLSLSPGERATLSCRASQSVDTTYLAWYQQKPGQAPRLLIFDASSRATGIPDRFSGSGSGTDFTLTISRLEPEDFAVYYCQQYGSSPFTFGGGTKVEIK

SEQ ID NO: 133 - protein, 108 aa, Artificial Sequence
  Description of Artificial Sequence: Synthetic polypeptide
EIVLTQSPGTLSLSPGERATLSCRASQSVSSTYLAWYQQKPGQAPRLLIYGASSRATGIPDRFSGSGSGTDFTLTISRLEPEDFAVYYCQQYGSSPYTFGQGTTLEIK

SEQ ID NO: 134 - protein, 108 aa, Artificial Sequence
  Description of Artificial Sequence: Synthetic polypeptide
EIVLTQSPGTLSLSPGERATLSCRASQSVSNNYLAWYQQKPGQAPRLLLYGASSRTTDIPDRFSGSGSGTDFTLTISRLEPEDFAVYYCQQYDNSPLTFGGGTKVEIR

SEQ ID NO: 135 - protein, 108 aa, Artificial Sequence; identical to SEQ ID NO: 125
  Description of Artificial Sequence: Synthetic polypeptide

SEQ ID NO: 136 - protein, 108 aa, Artificial Sequence
  Description of Artificial Sequence: Synthetic polypeptide
ETVLTQSPGTLSLSPGERATLSCRASQSVSSSYVAWYQQKPGQAPRRLIYGASSRATGIPGRFSGSGSGTDFTLTISRLEPEDFAVYYCQQYGSSPWTFGQGTKVEIK

SEQ ID NO: 137 - protein, 108 aa, Artificial Sequence
  Description of Artificial Sequence: Synthetic polypeptide
EIVLTQSPGTLSLSPGERATLSCRASQSVSSNYLAWYQQTPGQAPRLLIYGASSRATGIPDRFSGSGSGTDFTLTISRLEPEDFAVYYCQQYGSSPWTFGQGTKVEIK

SEQ ID NO: 138 - protein, 108 aa, Artificial Sequence; identical to SEQ ID NO: 125
  Description of Artificial Sequence: Synthetic polypeptide

SEQ ID NO: 139 - protein, 108 aa, Artificial Sequence; identical to SEQ ID NO: 137
  Description of Artificial Sequence: Synthetic polypeptide

SEQ ID NO: 140 - protein, 108 aa, Artificial Sequence
  Description of Artificial Sequence: Synthetic polypeptide
DIQMTQSPSSLSASVGDRVTITCRASQSVSRYLNWCQQKPGKAPKLLTYAASSLQSGVPSRFSGSGSGTDFTLTISSLQPEDFAAYFCQQSYSTPPITFGQGTRLEIK

SEQ ID NO: 141 - protein, 108 aa, Artificial Sequence
  Description of Artificial Sequence: Synthetic polypeptide
DIQMTQSPSSLSASVGDRVTITCRASQSISNYLNWYQQKPGKAPKLLIYAASSLQSGVPSRFSGSGSGTDFTLTISSLQPEDFATYYCQQSYSTPPITFGQGTRLEIK

SEQ ID NO: 142 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGNSPWTFGQGTKVEIK

SEQ ID NO: 143 - protein, 113 aa, Artificial Sequence
  Description of Artificial Sequence: Synthetic polypeptide
DIVMTQSPDSLAVSLGERATINCKSSQSVLYRSNNKNYLGWYQQKPGQPPKLLIYWASSREAGVPDRFSGSGSGTEFTLTISSLQAEDEAVYYCQQYYSSPPTFGQGTKVEIK

SEQ ID NO: 144 - protein, 113 aa, Artificial Sequence
  Description of Artificial Sequence: Synthetic polypeptide
YIVMTQSPDSLAVSLGERATINCKSSRSILYTSNNKNYLAWYQQRPGQPPKLLIYWASTRESGVPDRFSGSGSGTDFTLTISSLQAEDVAVYYCQQYFSSPPTFGQGTKVEIK

SEQ ID NO: 145 - protein, 113 aa, Artificial Sequence
  Description of Artificial Sequence: Synthetic polypeptide
DIVMTQSPDSLAVSLGGRATINCKSSQSVLHSSYNKDHLAWYQQRPGQPPKLLIYWASTRESGVPDRFSGSGSGTDFTLTISSLQAEDVAVYYCQQYNILPPTFGQGTRVEIK

SEQ ID NO: 146 - protein, 6 aa, Artificial Sequence
  Description of Artificial Sequence: Synthetic peptide
QSINIY

SEQ ID NO: 147 - protein, 6 aa, Artificial Sequence
  Description of Artificial Sequence: Synthetic peptide
QSISTY

SEQ ID NO: 148 - protein, 6 aa, Artificial Sequence
  Description of Artificial Sequence: Synthetic peptide
QSISNY

SEQ ID NO: 149 - protein, 6 aa, Artificial Sequence
  Description of Artificial Sequence: Synthetic peptide
QSISNY

SEQ ID NO: 150 - protein, 6 aa, Artificial Sequence
  Description of Artificial Sequence: Synthetic peptide
QSISSY

SEQ ID NO: 151 - protein, 6 aa, Artificial Sequence
  Description of Artificial Sequence: Synthetic peptide
QSINSY

SEQ ID NO: 152 - protein, 6 aa, Artificial Sequence
  Description of Artificial Sequence: Synthetic peptide
QSISSY

SEQ ID NO: 153 - protein, 7 aa, Artificial Sequence
  Description of Artificial Sequence: Synthetic peptide
QSITSSY

SEQ ID NO: 154 - protein, 7 aa, Artificial Sequence
  Description of Artificial Sequence: Synthetic peptide
QSVSSSY

SEQ ID NO: 155 - protein, 7 aa, Artificial Sequence
  Description of Artificial Sequence: Synthetic peptide
QTVSSSY

SEQ ID NO: 156 - protein, 7 aa, Artificial Sequence
  Description of Artificial Sequence: Synthetic peptide
QSLSSNY

SEQ ID NO: 157 - protein, 7 aa, Artificial Sequence
  Description of Artificial Sequence: Synthetic peptide
QSVSNRY

SEQ ID NO: 158 - protein, 7 aa, Artificial Sequence
  Description of Artificial Sequence: Synthetic peptide
QSVSSSY

SEQ ID NO: 159 - protein, 7 aa, Artificial Sequence
  Description of Artificial Sequence: Synthetic peptide
QSVSNRY

SEQ ID NO: 160 - protein, 6 aa, Artificial Sequence
  Description of Artificial Sequence: Synthetic peptide
QSISSY

SEQ ID NO: 161 - protein, 7 aa, Artificial Sequence
  Description of Artificial Sequence: Synthetic peptide
QSVDTTY

SEQ ID NO: 162 - protein, 7 aa, Artificial Sequence
  Description of Artificial Sequence: Synthetic peptide
QSVSSTY

SEQ ID NO: 163 - protein, 7 aa, Artificial Sequence
  Description of Artificial Sequence: Synthetic peptide
QSVSNNY

SEQ ID NO: 164 - protein, 7 aa, Artificial Sequence
  Description of Artificial Sequence: Synthetic peptide
QSVSSSY

SEQ ID NO: 165 - protein, 7 aa, Artificial Sequence
  Description of Artificial Sequence: Synthetic peptide
QSVSSSY

SEQ ID NO: 166 - protein, 7 aa, Artificial Sequence
  Description of Artificial Sequence: Synthetic peptide
QSVSSNY

SEQ ID NO: 167 - protein, 7 aa, Artificial Sequence
  Description of Artificial Sequence: Synthetic peptide
QSVSSSY

SEQ ID NO: 168 - protein, 7 aa, Artificial Sequence
  Description of Artificial Sequence: Synthetic peptide
QSVSSNY

SEQ ID NO: 169 - protein, 6 aa, Artificial Sequence
  Description of Artificial Sequence: Synthetic peptide
QSVSRY

SEQ ID NO: 170 - protein, 6 aa, Artificial Sequence
  Description of Artificial Sequence: Synthetic peptide
QSISNY

SEQ ID NO: 171 - protein, 7 aa, Artificial Sequence
  Description of Artificial Sequence: Synthetic peptide
QSVSSSY

SEQ ID NO: 172 - protein, 12 aa, Artificial Sequence
  Description of Artificial Sequence: Synthetic peptide
QSVLYRSNNKNY

SEQ ID NO: 173 - protein, 12 aa, Artificial Sequence
  Description of Artificial Sequence: Synthetic peptide
RSILYTSNNKNY

SEQ ID NO: 174 - protein, 12 aa, Artificial Sequence
  Description of Artificial Sequence: Synthetic peptide
QSVLHSSYNKDH

SEQ ID NO: 175 - protein, 3 aa, Artificial Sequence
  Description of Artificial Sequence: Synthetic peptide
AAS

SEQ ID NO: 176 - protein, 3 aa, Artificial Sequence
  Description of Artificial Sequence: Synthetic peptide
TAS

SEQ ID NO: 177 - protein, 3 aa, Artificial Sequence
  Description of Artificial Sequence: Synthetic peptide
TAS

SEQ ID NO: 178 - protein, 3 aa, Artificial Sequence
  Description of Artificial Sequence: Synthetic peptide
TAS

SEQ ID NO: 179 - protein, 3 aa, Artificial Sequence
  Description of Artificial Sequence: Synthetic peptide
AAS

SEQ ID NO: 180 - protein, 3 aa, Artificial Sequence
  Description of Artificial Sequence: Synthetic peptide
AAS

SEQ ID NO: 181 - protein, 3 aa, Artificial Sequence
  Description of Artificial Sequence: Synthetic peptide
AAS

SEQ ID NO: 182 - protein, 3 aa, Artificial Sequence
  Description of Artificial Sequence: Synthetic peptide
GAS

SEQ ID NO: 183 - protein, 3 aa, Artificial Sequence
  Description of Artificial Sequence: Synthetic peptide
GAS

SEQ ID NO: 184 - protein, 3 aa, Artificial Sequence
  Description of Artificial Sequence: Synthetic peptide
GAS

SEQ ID NO: 185 - protein, 3 aa, Artificial Sequence
  Description of Artificial Sequence: Synthetic peptide
GIS

SEQ ID NO: 186 - protein, 3 aa, Artificial Sequence
  Description of Artificial Sequence: Synthetic peptide
GAS

SEQ ID NO: 187 - protein, 3 aa, Artificial Sequence
  Description of Artificial Sequence: Synthetic peptide
GAS

SEQ ID NO: 188 - protein, 3 aa, Artificial Sequence
  Description of Artificial Sequence: Synthetic peptide
GAS

SEQ ID NO: 189 - protein, 3 aa, Artificial Sequence
  Description of Artificial Sequence: Synthetic peptide
AAS

SEQ ID NO: 190 - protein, 3 aa, Artificial Sequence
  Description of Artificial Sequence: Synthetic peptide
DAS

SEQ ID NO: 191 - protein, 3 aa, Artificial Sequence
  Description of Artificial Sequence: Synthetic peptide
GAS

SEQ ID NO: 192 - protein, 3 aa, Artificial Sequence
  Description of Artificial Sequence: Synthetic peptide
GAS

SEQ ID NO: 193 - protein, 3 aa, Artificial Sequence
  Description of Artificial Sequence: Synthetic peptide
GAS

SEQ ID NO: 194 - protein, 3 aa, Artificial Sequence
  Description of Artificial Sequence: Synthetic peptide
GAS

SEQ ID NO: 195 - protein, 3 aa, Artificial Sequence
  Description of Artificial Sequence: Synthetic peptide
GAS

SEQ ID NO: 196 - protein, 3 aa, Artificial Sequence
  Description of Artificial Sequence: Synthetic peptide
GAS

SEQ ID NO: 197 - protein, 3 aa, Artificial Sequence
  Description of Artificial Sequence: Synthetic peptide
GAS

SEQ ID NO: 198 - protein, 3 aa, Artificial Sequence
  Description of Artificial Sequence: Synthetic peptide
AAS

SEQ ID NO: 199 - protein, 3 aa, Artificial Sequence
  Description of Artificial Sequence: Synthetic peptide
AAS

SEQ ID NO: 200 - protein, 3 aa, Artificial Sequence
  Description of Artificial Sequence: Synthetic peptide
GAS

SEQ ID NO: 201 - protein, 3 aa, Artificial Sequence
  Description of Artificial Sequence: Synthetic peptide
WAS

SEQ ID NO: 202 - protein, 3 aa, Artificial Sequence
  Description of Artificial Sequence: Synthetic peptide
WAS

SEQ ID NO: 203 - protein, 3 aa, Artificial Sequence
  Description of Artificial Sequence: Synthetic peptide
WAS

SEQ ID NO: 204 - protein, 10 aa, Artificial Sequence
  Description of Artificial Sequence: Synthetic peptide
QHSYSTPPIT

SEQ ID NO: 205 - protein, 10 aa, Artificial Sequence
  Description of Artificial Sequence: Synthetic peptide
QQSYSTPPIT

SEQ ID NO: 206 - protein, 10 aa, Artificial Sequence
  Description of Artificial Sequence: Synthetic peptide
QQSYSTPPIT

SEQ ID NO: 207 - protein, 10 aa, Artificial Sequence
  Description of Artificial Sequence: Synthetic peptide
QQSYSTPPIT

SEQ ID NO: 208 - protein, 10 aa, Artificial Sequence
  Description of Artificial Sequence: Synthetic peptide
QQSYSTPPIT

SEQ ID NO: 209 - protein, 10 aa, Artificial Sequence
  Description of Artificial Sequence: Synthetic peptide
QQSYSSPPIT

SEQ ID NO: 210 - protein, 10 aa, Artificial Sequence
  Description of Artificial Sequence: Synthetic peptide
QQSYSTPPIT

SEQ ID NO: 211 - protein, 9 aa, Artificial Sequence
  Description of Artificial Sequence: Synthetic peptide
QQYGSSPWT

SEQ ID NO: 212 - protein, 9 aa, Artificial Sequence
  Description of Artificial Sequence: Synthetic peptide
QQYGSSPWT

SEQ ID NO: 213 - protein, 9 aa, Artificial Sequence
  Description of Artificial Sequence: Synthetic peptide
QQYGSSPWT

SEQ ID NO: 214 - protein, 9 aa, Artificial Sequence
  Description of Artificial Sequence: Synthetic peptide
QQYGSSPWT

SEQ ID NO: 215 - protein, 9 aa, Artificial Sequence
  Description of Artificial Sequence: Synthetic peptide
HQYGSSPWT

SEQ ID NO: 216 - protein, 9 aa, Artificial Sequence
  Description of Artificial Sequence: Synthetic peptide
QQYGSSPWT

SEQ ID NO: 217 - protein, 9 aa, Artificial Sequence
  Description of Artificial Sequence: Synthetic peptide
QQYGSSPWA

SEQ ID NO: 218 - protein, 10 aa, Artificial Sequence
  Description of Artificial Sequence: Synthetic peptide
QQSYSTPPIT

SEQ ID NO: 219 - protein, 9 aa, Artificial Sequence
  Description of Artificial Sequence: Synthetic peptide
QQYGSSPFT

SEQ ID NO: 220 - protein, 9 aa, Artificial Sequence
  Description of Artificial Sequence: Synthetic peptide
QQYGSSPYT

SEQ ID NO: 221 - protein, 9 aa, Artificial Sequence
  Description of Artificial Sequence: Synthetic peptide
QQYDNSPLT

SEQ ID NO: 222 - protein, 9 aa, Artificial Sequence
  Description of Artificial Sequence: Synthetic peptide
QQYGSSPWT

SEQ ID NO: 223 - protein, 9 aa, Artificial Sequence
  Description of Artificial Sequence: Synthetic peptide
QQYGSSPWT

SEQ ID NO: 224 - protein, 9 aa, Artificial Sequence
  Description of Artificial Sequence: Synthetic peptide
QQYGSSPWT

SEQ ID NO: 225 - protein, 9 aa, Artificial Sequence
  Description of Artificial Sequence: Synthetic peptide
QQYGSSPWT

SEQ ID NO: 226 - protein, 9 aa, Artificial Sequence
  Description of Artificial Sequence: Synthetic peptide
QQYGSSPWT

SEQ ID NO: 227 - protein, 10 aa, Artificial Sequence
  Description of Artificial Sequence: Synthetic peptide
QQSYSTPPIT

SEQ ID NO: 228 - protein, 10 aa, Artificial Sequence
  Description of Artificial Sequence: Synthetic peptide
QQSYSTPPIT

SEQ ID NO: 229 - protein, 9 aa, Artificial Sequence
  Description of Artificial Sequence: Synthetic peptide
QQYGNSPWT

SEQ ID NO: 230 - protein, 9 aa, Artificial Sequence
  Description of Artificial Sequence: Synthetic peptide
QQYYSSPPT

SEQ ID NO: 231 - protein, 9 aa, Artificial Sequence
  Description of Artificial Sequence: Synthetic peptide
QQYFSSPPT

SEQ ID NO: 232 - protein, 9 aa, Artificial Sequence
  Description of Artificial Sequence: Synthetic peptide
QQYNILPPT

SEQ ID NO: 233 - protein, 123 aa, Artificial Sequence
  Description of Artificial Sequence: Synthetic polypeptide
EVQLVESGGGLVQPGGSLRLSCAATGFTFDDFTMHWVRQAPGKGLEWVSGISWNSGSIGYVDSVKGRFTISRDNAKNSLYLQMNSLRAEDTALYYCAKDNSGYGYYYYGMDVWGQGTTVTVSS

SEQ ID NO: 234 - protein, 124 aa, Artificial Sequence
  Description of Artificial Sequence: Synthetic polypeptide
EVQLVESGGGLVQPGGSLRLSCAASGFSFDDYTMHWVRQPPGKGLEWVSGISWNSGSIGYADSVKGRFTISRDNAKNSLYLQMNSLRAGDTALYYCAKDNSGYGYYYYYGMDVWGQGTTVTVSS

SEQ ID NO: 235 - protein, 124 aa, Artificial Sequence
  Description of Artificial Sequence: Synthetic polypeptide
EVQLVESGGGLVQPGRSLRLSCVASGFPFADYTMHWVRQAPGKGLEWVSDISWNSGSKGYADSVKGRFTISRDNAKNSLYLQMNSLRTEDTAFYYCAKDMSGYAHYFYYGMDVWGQGTTVTVSS

SEQ ID NO: 236 - protein, 124 aa, Artificial Sequence
  Description of Artificial Sequence: Synthetic polypeptide
EVQLVESGGGLVQPGRSLRLSCAASGFTFDDYTMHWVRQVPGKGLEWVSGISWNSGSLAYADSVKGRFTISRDNAKNSLYLQMNSLHPEDTALYYCVKDGSGYGHYSYYGLDVWGQGTTVTVSS

SEQ ID NO: 237 - protein, 124 aa, Artificial Sequence
  Description of Artificial Sequence: Synthetic polypeptide
EVQLVESGGGLVQPGRSLRLSCVASGFPFADYTMHWVRQAPGKGLEWVSDISWNSGSIGYADSVKGRFTISRDNAKNSLYLQMNSLRTEDTALYYCAKDMSGYAHYFYYGMDVWGQGTTVTVSS

SEQ ID NO: 238 - protein, 124 aa, Artificial Sequence
  Description of Artificial Sequence: Synthetic polypeptide
EVQLVESGGGLVQPGRSLKLSCTASGFTFADYTMHWVRQGPGKGLEWVSDISWNSGSKGYADSVKGRFTISRDNAKNSLYLQMNSLRTEDTALYYCAKDMSGYAHYYYYALDVWGQGTTVTVSS

SEQ ID NO: 239 - protein, 121 aa, Artificial Sequence
  Description of Artificial Sequence: Synthetic polypeptide
QVQLVESGGGVVQPGRSLRLSCAASGFTFSRKGMHWVRQAPVKGLEWVAVISYDGSNKYYADSVKGRFTISRDNSKNTLYLQMNSLTAEDTAVYYCAKEGGHDYGGTFDYWGQGTLVTVSS

SEQ ID NO: 240 - protein, 123 aa, Artificial Sequence
  Description of Artificial Sequence: Synthetic polypeptide
EVQLVESGGGLVQPGRSLRLSCAASGFTFDDYTMHWVRQAPGKGLEWVSGISWNSGSIGYADSVKGRFTISRDNAKKSLYLQMNSLRAEDTALYYCAKDNSGYGHYYYGMDVWGQGTTVTVAS

SEQ ID NO: 241 - protein, 123 aa, Artificial Sequence; identical to SEQ ID NO: 240
  Description of Artificial Sequence: Synthetic polypeptide

SEQ ID NO: 242 - protein, 118 aa, Artificial Sequence
  Description of Artificial Sequence: Synthetic polypeptide
QVQLVESGGGVVQPGRSLRLSCGASGFTFRSYGMHWVRQTPGRGLEWVAMIYYDGNNKYYADSVRGRFTVSRDNSKNTLYLQMSSLRAEDTALYFCARGPGYNWLDPWGQGTLVTVSS

SEQ ID NO: 243 - protein, 118 aa, Artificial Sequence
  Description of Artificial Sequence: Synthetic polypeptide
QVQLVESGGGVVQPGRSLRLACVASGFTFRSYGMHWVRQAPGKGLQWVAMIYYDGKNKYYADSVRGRFTISRDNSKNTLYLQMNNLRVEDTAMYFCARGPGYNWLDPWGQGTLVTVSS

SEQ ID NO: 244 - protein, 118 aa, Artificial Sequence
  Description of Artificial Sequence: Synthetic polypeptide
QVQLVESGGGVVQPGRSLRLSCAASGFTFRSYAMHWVRQAPGKGLEWVAMVYYDGNNQYYADSVRGRFTISRDNSKNTLYLQMNSLRADDTAVYFCARGPGYNWLDPWGQGTLVTVSS

SEQ ID NO: 245 - protein, 118 aa, Artificial Sequence
  Description of Artificial Sequence: Synthetic polypeptide
QVQLVESGGGVVQPGRSLRLSCIASGFTFRSYGMHWVRQAPGKGLEWVAMIYYDGNNKYYADSVRGRFTISRDNSKNTLYLQMNSLRADDTAVYFCARGPGYNWLDPWGQGTLVTVSS

SEQ ID NO: 246 - protein, 118 aa, Artificial Sequence
  Description of Artificial Sequence: Synthetic polypeptide
QVQLVESGGGVVQPGRSLRLSCAASGFTFRSFGMHWVRQAPGRGLEWVAMIYFDGKNKYYADSVRGRFTISRDNSKNTLYLEMSSLRAEDTAVYFCARGPGYNWLDPWGQGTLVTVSS

SEQ ID NO: 247 - protein, 118 aa, Artificial Sequence; identical to SEQ ID NO: 246
  Description of Artificial Sequence: Synthetic polypeptide

SEQ ID NO: 248 - protein, 118 aa, Artificial Sequence; identical to SEQ ID NO: 246
  Description of Artificial Sequence: Synthetic polypeptide

SEQ ID NO: 249 - protein, 118 aa, Artificial Sequence; identical to SEQ ID NO: 246
  Description of Artificial Sequence: Synthetic polypeptide

SEQ ID NO: 250 - protein, 118 aa, Artificial Sequence
  Description of Artificial Sequence: Synthetic polypeptide
QVQLVESGGGVVQPGRSLRLSCVASGFTFRSYGMHWVRQAPGKGLQWVAMIYYDGKNKYYADSVRGRFTISRDNSKNTLYLQMNSLRAEDTAMYFCARGPGYNWLDPWGQGTLVTVSS

SEQ ID NO: 251 - protein, 118 aa, Artificial Sequence; identical to SEQ ID NO: 246
  Description of Artificial Sequence: Synthetic polypeptide

SEQ ID NO: 252 - protein, 118 aa, Artificial Sequence; identical to SEQ ID NO: 246
  Description of Artificial Sequence: Synthetic polypeptide

SEQ ID NO: 253 - protein, 118 aa, Artificial Sequence; identical to SEQ ID NO: 245
  Description of Artificial Sequence: Synthetic polypeptide

SEQ ID NO: 254 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSRSIDYADSVKGRFTISRDNAKNSLYLQMNSLRAEDTALYYCVKDNSGYGRYYYYGMDVWGQGTTVSVSS

SEQ ID NO: 255 - protein, 123 aa, Artificial Sequence; identical to SEQ ID NO: 233
  Description of Artificial Sequence: Synthetic polypeptide

SEQ ID NO: 256 - protein, 123 aa, Artificial Sequence
  Description of Artificial Sequence: Synthetic polypeptide
QVTLKESGPALVKPTQTLTLTCTFSGFSLSTSGMCVSWIRQPPGKALEWLARIDWDDDKYYSTSLKTRLTISKDTSKNQVVLTMTNMDPVDTATYYCARMDIVGARGGWFDPWGQGTLVTVSS

SEQ ID NO: 257 - protein, 134 aa, Artificial Sequence
  Description of Artificial Sequence: Synthetic polypeptide
QVQLVESGGGVVQPGRSLRLSCAASGFTFRSYGMHWVRQAPGKGLEWVAMIYYDGNNKKYADSVRGRFTISRDNSKNTLYLQMNSLRVEDTAVYFCARGPGYNWLDPWGQGTLVTVSSAKTTAPPVYPLAPGSL

SEQ ID NO: 258 - protein, 118 aa, Artificial Sequence; identical to SEQ ID NO: 246
  Description of Artificial Sequence: Synthetic polypeptide

SEQ ID NO: 259 - protein, 118 aa, Artificial Sequence; identical to SEQ ID NO: 246
  Description of Artificial Sequence: Synthetic polypeptide

SEQ ID NO: 260 - protein, 117 aa, Artificial Sequence
  Description of Artificial Sequence: Synthetic polypeptide
QVHLEESGGGVVQPGRSLRLSCSASGFTFSSYAMHWVRQAPGKGLEWVAVIWYDGTNKYYLDSVKGRFTISRDNSKNTLFLQMNSLRAEDTAVYYCARDRGSIITHWGQGTLVTVSS

SEQ ID NO: 261 - protein, 124 aa, Artificial Sequence
  Description of Artificial Sequence: Synthetic polypeptide
EVQLVESGGGLVRPGRSLRLSCAASGFTFDDYTMHWVRQAPGKGLEWVSDISWNSGTIGYADSVKGRFTISRDNAKNSLYLQMNSLRPEDTALYYCAKDMSGYAHYYYYGMDVWGQGTTVTVSS

SEQ ID NO: 262 - protein, 124 aa, Artificial Sequence
  Description of Artificial Sequence: Synthetic polypeptide
EVQLVESGGGLVQPGRSLRLSCAASGFTFDDYTMHWVRQAPGKGLEWVSDISWNSGSIGYADSVKGRFTVSRDNAKNSLYLQMNSLRGEDTALYYCAKDMSGYAHYGYYGMDVWGQGTTVTVSS

SEQ ID NO: 263 - protein, 123 aa, Artificial Sequence
  Description of Artificial Sequence: Synthetic polypeptide
EAQLVESGGGLVQPGRSLRLSCTTSGFTFDDYTMHWVRQAPGKGLEWISDISWNGGTKGYADSVKGRFTISRDNAKNSLYLQMDSLRGEDTALYYCVKDKSGYGHFYFGLDVWGQGTTVTVSS

SEQ ID NO: 264 - protein, 123 aa, Artificial Sequence
  Description of Artificial Sequence: Synthetic polypeptide
EVQLVESGGGLVQPGRSLRLSCAASGFKFADYAMHWVRQAPGKGLEWVSEISWNSGSIGYVDSVKGRFTISRDNAKNSLYLQMNSLRAEDTALYYCVKDKSGYGHYYIGMDVWGQGTTVIVSS

SEQ ID NO: 265 - protein, 124 aa, Artificial Sequence
  Description of Artificial Sequence: Synthetic polypeptide
EVHLVESGGGLVQPGRSLRLSCAASGFTFDDYTMHWVRQAPGKGLEWVSDISWNSGSIGYADSVKGRFTVSRDNAKNSLYLQMNSLRGEDTALYYCAKDMSGYGHYGKYGMDVWGQGTTVTVSS

SEQ ID NO: 266 - protein, 124 aa, Artificial Sequence
  Description of Artificial Sequence: Synthetic polypeptide
EVQLVESGGDLVQPGRSLRLSCAASGFTFDDYTMHWVRQAPGKGLEWVSIISWNGNTIDYADSVKGRFTISRDNAKNSLYLQMNSLRAEDTALYYCAKDKSGYGHFYYYVLDVWGQGTTVTVSS

SEQ ID NO: 267 - protein, 121 aa, Artificial Sequence
  Description of Artificial Sequence: Synthetic polypeptide
QVQLVESGGGVVQPGRSLRPSCAASGFSFRDYGMHWVRQAPGKGLEWMAHIWYNGKNKYYADSVKGRFTISRDNSKNTLYLQMNSLRPEDTAVYYCARDGVSARGTPFDYWGQGTLVTVSS

SEQ ID NO: 268 - protein, 128 aa, Artificial Sequence
  Description of Artificial Sequence: Synthetic polypeptide
QVQLVESGGGLVQPGGSLRLSCAASYFTFSSFAMNWVRQAPGQGLEWVSAISGRVSAISGSGGITYYADSVKGRFIISRDNSKNTLYLQMSGLRAEDTAVYYCAKGPYLTTVTPFDYWGQGTLVTVSS

SEQ ID NO: 269 - protein, 123 aa, Artificial Sequence
  Description of Artificial Sequence: Synthetic polypeptide
EVQLVESGGGLVQPGRSLRLSCAASGFTFADYAMHWVRQAPGKGLEWVSGISWNSGSIGYADSVKGRFTISRDNAKNSLYLQMNSLRAEDTALYYCVKDNSGYASYYYGMDVWGQGTTVTVSS

SEQ ID NO: 270 - protein, 126 aa, Artificial Sequence
  Description of Artificial Sequence: Synthetic polypeptide
EVQLVESGGGVVQPGRSLRLSCAASGFTFSNYGMHWVRQAPGKGLEWVTVILHDGSYKYYADSVKGRFTISRDNSKNTLHLQMNSLRTEDTAVYYCAKGPMFRGVPYNHYYGMDVWGQGTTVTVSS

SEQ ID NO: 271 - protein, 119 aa, Artificial Sequence
  Description of Artificial Sequence: Synthetic polypeptide
EVQLVESGGGVVQPGRSLRLSCTASGFPFSRYGMHWVRQAPGKGLEWVTFIWYDGSNKYYADSAKGRFTITRDNSKNTVYLQMDSLRADDTAVYYCVRDQAALYYFDSWGQGTLVTVSS

SEQ ID NO: 272 - protein, 126 aa, Artificial Sequence
  Description of Artificial Sequence: Synthetic polypeptide
EVQLVESGGGVVQPGRSLRLSCAASGFTFSSYGMHWVRQAPGKGLEWVTVILHDGSNRYSADSVKGRFTISRDNSKNTLYLQMNILRVEDTAVYYCTKGAMVRGVPYNHYYGMDVWGQGTTVTVSS

SEQ ID NO: 273 - protein, 126 aa, Artificial Sequence
  Description of Artificial Sequence: Synthetic polypeptide
EVQLVESGGGVVQPGRSLRLSCAASGFTFSSYGMHWVRQAPGKGLEWVTVILHDGSNRYYADSVKGRFTISRDNSKNTLYLQMNILRAEDTAVYYCTKGAMVRGVPYNHYYGMDVWGQGTTVTVSS

SEQ ID NO: 274 - protein, 126 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDYSKNTLYLQMNSLRAEDTAVFYCAKGAMVRGVPYNYYYGMDVWGQGTTVTVSS

SEQ ID NO: 275 - protein, 126 aa, Artificial Sequence
  Description of Artificial Sequence: Synthetic polypeptide
QVQLVESGGGVVQPGRSLRLSCAASGLTFSSYGMHWVRQAPGKGLEWVAVISYDGSNKYYTDSVKGRFTISRDNSKNTLYLQMNSLRAEDTAVYYCAKGAMVRGVPYNYYYGMDVWGQGTTVTVSS

SEQ ID NO: 276 - protein, 126 aa, Artificial Sequence
  Description of Artificial Sequence: Synthetic polypeptide
QVQLVESGGGVVQPGRSLRLSCAASGFTFRSFGMHWVRQAPGKGLEWVAVISYDGNYKYYADSVKGRFTISRDNSKNTLYLQMNSLRAEDTAVHYCAKGAMVRGVPYNFYYGMDVWGQGTTVTVSS

SEQ ID NO: 277 - protein, 123 aa, Artificial Sequence
  Description of Artificial Sequence: Synthetic polypeptide
EVQLVESGGGLVQPGRSLRLSCAASGFTFDDYTMHWVRQVPGKGLEWISGISWNSGSMDYADSVKGRFTISRDNARNSLFLQMNSVRTEDTALYYCAKDKSGYGSFYYGMDVWGQGTTVTVSS

SEQ ID NO: 278 - protein, 123 aa, Artificial Sequence
  Description of Artificial Sequence: Synthetic polypeptide
EVQLVESGGGLVQPGRSLRLSCAASGFSFDNYAMHWVRQAPGQGLEWVSGISWNSGSRDYADSVKGRFTISRDNARNSLFLQMNSLSNEDTAMYYCAKDKSGYGSYFYGMDVWGQGTTVTVSS

SEQ ID NO: 279 - protein, 123 aa, Artificial Sequence
  Description of Artificial Sequence: Synthetic polypeptide
QVQLVESGGGLVQPGRSLRLSCAASGFSFDDYAMHWVRQAPGQGLEWVSGISWNGGSRDYADSVKGRFTISRDNARNSLFLQMNSLFTEDTALYYCAKDKSGYGSYFYGMDVWGQGTTVTVSS

SEQ ID NO: 280 - protein, 123 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSRDYADSVKGRFTISRDNARNSLFLQMNSLSTEDTALYYCAKDKSGYGSYYYGMDVWGQGTTVTVSS

SEQ ID NO: 281 - protein, 123 aa, Artificial Sequence
  Description of Artificial Sequence: Synthetic polypeptide
EVQLVESGGGLVQPGRSLRLSCVASGFTFADFTMHWVRQAPGKGLEWVSGISWNSNSIDYADSVKGRFTISRDNAKKSLFLQMSSLRAEDTALYYCVKDRSGYSRFYYGMDVWGQGTTVTVSS

SEQ ID NO: 282 - protein, 123 aa, Artificial Sequence
  Description of Artificial Sequence: Synthetic polypeptide
EVQLVESGGGLVQPGRSLRLSCAASGFTFDDYAMHWVRQAPGKGLEWVSGISWNGGSKDYADSVKGRFTISRDNTRNSLSLQMNSLRIEDTALYYCAKDKSGYGSFYYGLDVWGQGTTVTVSS

SEQ ID NO: 283 - protein, 123 aa, Artificial Sequence
  Description of Artificial Sequence: Synthetic polypeptide
EVQLVESGGGLVQPGRSLRLSCAASGFTFDDFTMHWVRQAPGKGLEWVSDISWNSGSIDYADSVKGRFTISRDNARNSLFLQMSSLRTEDTASYYCIKDKSGYGSYNYGLDVWGQGTTVTVSS

SEQ ID NO: 284 - protein, 123 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSKDYADSVKGRFTISRDNTRNSLFLQMNSLRTEDTALYYCAKDKSGYGSFYYGMDVWGQGTTVTVSS

SEQ ID NO: 285 - protein, 124 aa, Artificial Sequence
  Description of Artificial Sequence: Synthetic polypeptide
QVQLVESGGGVVQPGRSLRLSCAASGLTFSTYVMHWVRQAPGKGLAWVAVIANDGSNKYYADSVKGRFTISRDNSKNTLYLQMNSLRPEDTAVYFCAKEGGTSGSYYYYGMDVWGQGTTVTVSS

SEQ ID NO: 286 - protein, 118 aa, Artificial Sequence
  Description of Artificial Sequence: Synthetic polypeptide
QVQLVESGAEVKKPGASVKVSCKTSGYTFTGYYMHWIRQAPGQGLEWMGWINPKSGGTNYAQKFQGRVTMTRDTSISTAYMELSRLRSDDMAVYYCARMGDGAVFDFWGQGTLVTVSS

SEQ ID NO: 287 - protein, 123 aa, Artificial Sequence
  Description of Artificial Sequence: Synthetic polypeptide
EVQLVESGGGLVQPGRSLRLSCAASGFTFDDYTMHWVRQAPGKGLEWVSGISWNSGSIGYADSVKGRFTISRDNAKNSLYLQMNSLRAEDTALFYCAKDQSGYGHYYYGMDVWGQGTTVTVSS

SEQ ID NO: 288 - protein, 129 aa, Artificial Sequence
  Description of Artificial Sequence: Synthetic polypeptide
EVQLVESGGGVVQPGRSLRLSCAASGFTFSYYGMHWVRQAPGKGLEWVAVISFDGKNKYYADSVMGRFTISRDNSKNTLYLQMNSLRAEDSAVFFCARSYDILTGYGAGYSYHYGMDVWGQGTTVTVSS

SEQ ID NO: 289 - protein, 118 aa, Artificial Sequence
  Description of Artificial Sequence: Synthetic polypeptide
QVQLVESGAEVKKPGASVKVSCKTSGYTLSGYYMHWMRQAPGQGLEWMGWINPKSGVTNYAQKFQDRVAMTRDTSISTAYMELSRLRSDDTAVYYCARMGDGAVFDFWAQGTLVTVSS

SEQ ID NO: 290 - protein, 124 aa, Artificial Sequence
  Description of Artificial Sequence: Synthetic polypeptide
QVQLVESGGGVVQPGRSLRLSCAASGFTFSSYGMHWVRQAPGKGLEWVSTISFDGSNKYYADSVKGRFTISRDNSKNTLYLQMNSLRPEDTAVYYCAKGGGTSGSYFYYGMDVWGQGTTVTVSS

SEQ ID NO: 291 - protein, 118 aa, Artificial Sequence
  Description of Artificial Sequence: Synthetic polypeptide
QVQLVQSGTEVKKPGASMKVSCKASGYTFTGYYIHWVRQAPGQGLEWMGWINPNSDVTKYAQKFQGRVTLTRDTSISAAYIDLSRLRSDDTAIYYCARMGDGAVFDYWGQGTLVTVSS

SEQ ID NO: 292 - protein, 118 aa, Artificial Sequence
  Description of Artificial Sequence: Synthetic polypeptide
EVQLVESGAEVKKPGASVKVSCKTSGYSFIGYYIHWMRQAPGQGLEWMGWINPKSGVTNYAQRFQGRVTMTRDTSISTAYMELSRLKSDDTAVYFCARMGDGAVFDFWGQGTLVTVSS

SEQ ID NO: 293 - protein, 118 aa, Artificial Sequence
  Description of Artificial Sequence: Synthetic polypeptide
EVQLVESGAEVKKPGASVKVSCKTSGYTFTGYYMHWIRQAPGQGLEWMGWINPKSGGTNYAQKFQGRVTMTRDTSISTAYMELSRLRSDDMAVYYCARMGDGAVFDFWGQGTLVTVSS

SEQ ID NO: 294 - protein, 118 aa, Artificial Sequence
  Description of Artificial Sequence: Synthetic polypeptide
QVQLVQSGTEVKKPGASVKVSCKASGYTFTGYYMHWVRQAPGQGLEWMGWINPNSDVTNYAQKFQGRVTLTRDTSISTAYIDLSRLRSDDTAIYYCARMGDGAVFDYWGQGTLVTVSS

SEQ ID NO: 295 - protein, 127 aa, Artificial Sequence
  Description of Artificial Sequence: Synthetic polypeptide
QVQLVQSGGGLVKPGGSLRLSCAASGFTFSSYDMSWVRQAPGKGLEWVSYISSSGNTIHYADSVKGRFTISRDNSKNSLYLQMNSLRAEDTAVYYCAKAGPATVTRRYYYYYGLDVWGQGTTVTVSS

SEQ ID NO: 296 - protein, 118 aa, Artificial Sequence
  Description of Artificial Sequence: Synthetic polypeptide
QVQLVQSGAEVKKPGASVKVSCKASGYTFIGYYMHWVRQAPGQGLEWMGWINPKSGGTNYAQKFQGRVTMTGDTSISTAYMELSRLRSDDTAVFYCARMGDGAMFDYWGQGTLVTVSS

SEQ ID NO: 297 - protein, 125 aa, Artificial Sequence
  Description of Artificial Sequence: Synthetic polypeptide
QVQLVQSGGGVVQPGGSLRLSCAASGFTFDDYAMHWVRQAPGKGLEWVSLISGDGGSTYYADSVKGRFTISRDNSKNSLYLQMNSLRTEDTALYYCAKDDSSSSWYYYYYGMDVWGRGTTVTVSS

SEQ ID NO: 298 - protein, 124 aa, Artificial Sequence
  Description of Artificial Sequence: Synthetic polypeptide
EVQLVESGGGLVQPGRSLRLSCAASGFTFGDYTMHWVRQAPGKGLEWVSDISWNSGSKDYADSVKGRFTISRDNAKNSLYLQMNSLRTEDTAFYYCAKDSRGYGLYYHLGLDVWGQGTTVTVSS

SEQ ID NO: 299 - protein, 124 aa, Artificial Sequence
  Description of Artificial Sequence: Synthetic polypeptide
EVQLVESGGGLVQPGRSLRLSCAASGFTFADYTMHWVRQAPGKGLEWVSDISWNSGSIAYADSVKGRFTISRDNAKNSLYLQMNSLRTEDTAFYYCAKDSRGYGHYKYLGLDVWGQGTTVTVSS

SEQ ID NO: 300 - protein, 124 aa, Artificial Sequence
  Description of Artificial Sequence: Synthetic polypeptide
EVQLVESGGGMVQPGRSLRLSCAASGFPFNDYTMHWVRQVPGRGLEWVSDISWNSGSKGYADSVKGRFIISRDNAKNSLYLQMNSLRVEDTALYYCVKDGSGYGRFHYYAMDVWGQGTTVTVSS

SEQ ID NO: 301 - protein, 124 aa, Artificial Sequence
  Description of Artificial Sequence: Synthetic polypeptide
EVQLVESGGGLVQPGRSLRLSCAASGFTFADYTMHWVRQVPGKGLEWVSDISWNSGSKDYADSVKGRFTISRDNAKNFLYLQMNSLRAEDTALYYCVKYGSGYGKFYFYAMDVWGQGTTVTVSS

SEQ ID NO: 302 - protein, 124 aa, Artificial Sequence
  Description of Artificial Sequence: Synthetic polypeptide
EVQLVQSGGGLVQPGRSLRLSCAASGFTFADYTMHWVRQTPGKGLEWVSGISWNSGSKDYADSVKGRFTISRDNAKNSLYLQMNSLRTEDTALYYCAKYGSGYGRYFFYAMDVWGQGTTVTVSS

SEQ ID NO: 303 - protein, 124 aa, Artificial Sequence
  Description of Artificial Sequence: Synthetic polypeptide
EVQLVESRGALVQPGRSLRLSCAASGFAFNDYTMHWVRQAPGKGLEWVSDISWNSNSKDYADSVKGRFTISRDNAKNSLYLQMNSLRAEDTALYYCVKDGSGYGKFSLYALDVWGQGTTVTVSS

SEQ ID NO: 304 - protein, 124 aa, Artificial Sequence
  Description of Artificial Sequence: Synthetic polypeptide
QVQLVESGGGLVHPGRSLRLSCAASGFKFDDYTMHWVRQAPGKGLEWVSDISWNSGSKGYADSVKGRFTISRDNAKDSLYLQMDSLRAADTAFYYCAKDKSGYGHFYYYAMDVWGQGTTVTVSS

SEQ ID NO: 305 - protein, 124 aa, Artificial Sequence
  Description of Artificial Sequence: Synthetic polypeptide
EVQLVESGGGLVHPGRSLRLSCTASGFKFADYTMHWVRQAPGKGLEWVSDISWNSGSKGYADSVKGRFTISRDNDKNSLYLQMNSLRGEDTALYYCAKDGSGYGRFHFYAIDVWGQGTTVTVSS

SEQ ID NO: 306 - protein, 124 aa, Artificial Sequence
  Description of Artificial Sequence: Synthetic polypeptide
EVQLVESGGGLVQPGRSLRLSCVASGFTFDDYSMHWVRQAPGKGLEWVSGISWNSGSKDYADSVKGRFTISRDNAKNSLYLQMNSLRAEDTALYYCAKYGSGYGKFYHYGLDVWGQGTTVTVSS

SEQ ID NO: 307 - protein, 124 aa, Artificial Sequence
  Description of Artificial Sequence: Synthetic polypeptide
QVQLVESGGGLVQPGRSLRLSCAASGFTFADYTMHWVRQAPGKGLEWVSDISWNSGSMGYADSVKGRFTISRDNAKKSLYLQMNSLRTEDTALYYCAKDGSGYGKYFFYAMDVWGQGTTVTVSS

SEQ ID NO: 308 - protein, 124 aa, Artificial Sequence
  Description of Artificial Sequence: Synthetic polypeptide
EVQLVQSGGGLVQPGRSLRLSCAASGFTFSDYTMHWVRQGPGKGLEWVSDISWNSGSKGYTDSVKGRFTISRDNAKKSLYLQMNSLRAEDTALYYCVKDGSGYGKYHFYAMDVWGQGTLVTVSS

SEQ ID NO: 309 - protein, 124 aa, Artificial Sequence
  Description of Artificial Sequence: Synthetic polypeptide
EVQLVESGGGLVHPGRSLRLSCAASGFTFDDYTMHWVRQAPGKGLEWVSDISWNSGSRGYADSVKGRFTISRDNAENSLYLQMNSLRAEDTALYYCAKDKSGYGHYYYYAMDVWGQGTTVTVSS

SEQ ID NO: 310 - protein, 124 aa, Artificial Sequence
  Description of Artificial Sequence: Synthetic polypeptide
EVQLVESGGGLVQPGGSLRLSCEASGFTFADYTLHWVRQAPGKGLEWVSDISWNSGTRGYADSVRGRFTISRDNAKKSLYLQMNSLRSEDTALYYCVKDGSGYGRYNFYAMDVWGQGTTVTVSS

SEQ ID NO: 311 - protein, 123 aa, Artificial Sequence
  Description of Artificial Sequence: Synthetic polypeptide
EVQLVESGGGLVQPGRSLRLSCAASGFTFADYTMHWVRQGPGKGLEWVSDIGWNSNTIGYADSVKGRFAISRDNAKNSLYLQMNSLRPEDTALYYCVKDKSGYGKFQYGLDVWGQGTTVTVSS

SEQ ID NO: 312 - protein, 123 aa, Artificial Sequence
  Description of Artificial Sequence: Synthetic polypeptide
EVQLVESGGGLVQPGRSLRLSCAASGFTFDDYTMHWVRQGPGKGLEWVSDIGWNSNSIGYADSVKGRFTISRDNAKNSLYLQMNSLRPEDTALYFCVKDKSGYGKFFIGLDVWGQGTMVTVSS

SEQ ID NO: 313 - protein, 123 aa, Artificial Sequence
  Description of Artificial Sequence: Synthetic polypeptide
QVQLVESGGGLVQPGRSLRLSCAASGFTFDDYTMHWVRQGPGKGLEWVSDIGWNSNTKGYADSVKGRFTISRDNAKNSLYLQMNSLRPEDTALYFCVKDKSGYGKFFIGLDVWGQGTMVTVSS

SEQ ID NO: 314 - protein, 123 aa, Artificial Sequence
  Description of Artificial Sequence: Synthetic polypeptide
EVQLVESGGGLVQPGRSLRLSCAASGFTFADYTMHWVRQGPGTGLEWVSDIGWSGGSLGYADSVKGRFTISRDNAKNSLYLEMNNLRPEDTALYYCVKDKSGYGKFQYGLDVWGQGTTVTVSS

SEQ ID NO: 315 - protein, 123 aa, Artificial Sequence
  Description of Artificial Sequence: Synthetic polypeptide
EVQLVESGGGVVQPGRSLRLSCAASGFKFDGYTMHWVRQGPGKGLEWVSDIGWNSNTIGYADSVKGRFTISRDNAKNSLYLQMNSLRPEDTALYFCVKDKSGYGKFFIGLDVWGQGTMVTVSS

SEQ ID NO: 316 - protein, 123 aa, Artificial Sequence
  Description of Artificial Sequence: Synthetic polypeptide
QVQLVESGGGLVQPGRSLRLSCAASGFTFDDYTMHWVRQGPGKGLEWVSDIGWNSNTIGYADSVKGRFTISRDNARNSLYLQMNSLRPEDTALYYCVKDKSGYGKFQYGLDVWGQGTTVTVSS

SEQ ID NO: 317 - protein, 123 aa, Artificial Sequence
  Description of Artificial Sequence: Synthetic polypeptide
QVQLVESGGGLVQPGRSLRLSCAASGFKFDDYTMHWVRQGPGKGLEWVSDISWSGGSIDYTDSVKGRFSISRDNAKNSLYLQMNSLRVEDTALYYCVKDKSGYGKYSYGLDVWGQGTTVTVSS

SEQ ID NO: 318 - protein, 119 aa, Artificial Sequence
  Description of Artificial Sequence: Synthetic polypeptide
EVQLVESGGGLVKPGGSLRISCAASGFSFINAWMNWVRQAPGKGLEWVGRIKSISDGGTTDYAASVKGRFTISREDSKNMLFLEMNSLKTEDTAVFYCTTEVARTPNYWGRGTLVTVSS

SEQ ID NO: 319 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKYGSGYGKFYHYGLDVWGQGTTVTVSS

SEQ ID NO: 320 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKDGSGYGYFYYYGMDVWGQGTTVTVSS

SEQ ID NO: 321 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKDGSGYGKFYYYGMDVWGQGTTVTVSS

SEQ ID NO: 322 - protein, 8 aa, Artificial Sequence
  Description of Artificial Sequence: Synthetic peptide
GFTFDDFT

SEQ ID NO: 323 - protein, 8 aa, Artificial Sequence
  Description of Artificial Sequence: Synthetic peptide
GFSFDDYT

SEQ ID NO: 324 - protein, 8 aa, Artificial Sequence
  Description of Artificial Sequence: Synthetic peptide
GFPFADYT

SEQ ID NO: 325 - protein, 8 aa, Artificial Sequence
  Description of Artificial Sequence: Synthetic peptide
GFTFDDYT

SEQ ID NO: 326 - protein, 8 aa, Artificial Sequence
  Description of Artificial Sequence: Synthetic peptide
GFPFADYT

SEQ ID NO: 327 - protein, 8 aa, Artificial Sequence
  Description of Artificial Sequence: Synthetic peptide
GFTFADYT

SEQ ID NO: 328 - protein, 8 aa, Artificial Sequence
  Description of Artificial Sequence: Synthetic peptide
GFTFSRKG

SEQ ID NO: 329 - protein, 8 aa, Artificial Sequence
  Description of Artificial Sequence: Synthetic peptide
GFTFDDYT

SEQ ID NO: 330 - protein, 8 aa, Artificial Sequence
  Description of Artificial Sequence: Synthetic peptide
GFTFDDYT

SEQ ID NO: 331 - protein, 8 aa, Artificial Sequence
  Description of Artificial Sequence: Synthetic peptide
GFTFRSYG

SEQ ID NO: 332 - protein, 8 aa, Artificial Sequence
  Description of Artificial Sequence: Synthetic peptide
GFTFRSYG

SEQ ID NO: 333 - protein, 8 aa, Artificial Sequence
  Description of Artificial Sequence: Synthetic peptide
GFTFRSYA

SEQ ID NO: 334 - protein, 8 aa, Artificial Sequence
  Description of Artificial Sequence: Synthetic peptide
GFTFRSYG

SEQ ID NO: 335 - protein, 8 aa, Artificial Sequence
  Description of Artificial Sequence: Synthetic peptide
GFTFRSFG

SEQ ID NO: 336 - protein, 8 aa, Artificial Sequence
  Description of Artificial Sequence: Synthetic peptide
GFTFRSFG

SEQ ID NO: 337 - protein, 8 aa, Artificial Sequence
  Description of Artificial Sequence: Synthetic peptide
GFTFRSFG

SEQ ID NO: 338 - protein, 8 aa, Artificial Sequence
  Description of Artificial Sequence: Synthetic peptide
GFTFRSFG

SEQ ID NO: 339 - protein, 8 aa, Artificial Sequence
  Description of Artificial Sequence: Synthetic peptide
GFTFRSYG

SEQ ID NO: 340 - protein, 8 aa, Artificial Sequence
  Description of Artificial Sequence: Synthetic peptide
GFTFRSFG

SEQ ID NO: 341 - protein, 8 aa, Artificial Sequence
  Description of Artificial Sequence: Synthetic peptide
GFTFRSFG

SEQ ID NO: 342 - protein, 8 aa, Artificial Sequence
  Description of Artificial Sequence: Synthetic peptide
GFTFRSYG

SEQ ID NO: 343 - protein, 8 aa, Artificial Sequence
  Description of Artificial Sequence: Synthetic peptide
GFTFDDYS

SEQ ID NO: 344 - protein, 8 aa, Artificial Sequence
  Description of Artificial Sequence: Synthetic peptide
GFTFDDFT

SEQ ID NO: 345 - protein, 10 aa, Artificial Sequence
  Description of Artificial Sequence: Synthetic peptide
GFSLSTSGMC

SEQ ID NO: 346 - protein, 8 aa, Artificial Sequence
  Description of Artificial Sequence: Synthetic peptide
GFTFRSYG

SEQ ID NO: 347 - protein, 8 aa, Artificial Sequence
  Description of Artificial Sequence: Synthetic peptide
GFTFRSFG

SEQ ID NO: 348 - protein, 8 aa, Artificial Sequence
  Description of Artificial Sequence: Synthetic peptide
GFTFRSFG

SEQ ID NO: 349 - protein, 8 aa, Artificial Sequence
  Description of Artificial Sequence: Synthetic peptide
GFTFSSYA

SEQ ID NO: 350 - protein, 8 aa, Artificial Sequence
  Description of Artificial Sequence: Synthetic peptide
GFTFDDYT

SEQ ID NO: 351 - protein, 8 aa, Artificial Sequence
  Description of Artificial Sequence: Synthetic peptide
GFTFDDYT

SEQ ID NO: 352 - protein, 8 aa, Artificial Sequence
  Description of Artificial Sequence: Synthetic peptide
GFTFDDYT

SEQ ID NO: 353 - protein, 8 aa, Artificial Sequence
  Description of Artificial Sequence: Synthetic peptide
GFKFADYA

SEQ ID NO: 354 - protein, 8 aa, Artificial Sequence
  Description of Artificial Sequence: Synthetic peptide
GFTFDDYT

SEQ ID NO: 355 - protein, 8 aa, Artificial Sequence
  Description of Artificial Sequence: Synthetic peptide
GFTFDDYT

SEQ ID NO: 356 - protein, 8 aa, Artificial Sequence
  Description of Artificial Sequence: Synthetic peptide
GFSFRDYG

SEQ ID NO: 357 - protein, 8 aa, Artificial Sequence
  Description of Artificial Sequence: Synthetic peptide
YFTFSSFA

SEQ ID NO: 358 - protein, 8 aa, Artificial Sequence
  Description of Artificial Sequence: Synthetic peptide
GFTFADYA

SEQ ID NO: 359 - protein, 8 aa, Artificial Sequence
  Description of Artificial Sequence: Synthetic peptide
GFTFSNYG

SEQ ID NO: 360 - protein, 8 aa, Artificial Sequence
  Description of Artificial Sequence: Synthetic peptide
GFPFSRYG

SEQ ID NO: 361 - protein, 8 aa, Artificial Sequence
  Description of Artificial Sequence: Synthetic peptide
GFTFSSYG

SEQ ID NO: 362 - protein, 8 aa, Artificial Sequence
  Description of Artificial Sequence: Synthetic peptide
GFTFSSYG

SEQ ID NO: 363 - protein, 8 aa, Artificial Sequence
  Description of Artificial Sequence: Synthetic peptide
GFTFSSYG

SEQ ID NO: 364 - protein, 8 aa, Artificial Sequence
  Description of Artificial Sequence: Synthetic peptide
GLTFSSYG

SEQ ID NO: 365 - protein, 8 aa, Artificial Sequence
  Description of Artificial Sequence: Synthetic peptide
GFTFRSFG

SEQ ID NO: 366 - protein, 8 aa, Artificial Sequence
  Description of Artificial Sequence: Synthetic peptide
GFTFDDYT

SEQ ID NO: 367 - protein, 8 aa, Artificial Sequence
  Description of Artificial Sequence: Synthetic peptide
GFSFDNYA

SEQ ID NO: 368 - protein, 8 aa, Artificial Sequence
  Description of Artificial Sequence: Synthetic peptide
GFSFDDYA

SEQ ID NO: 369 - protein, 8 aa, Artificial Sequence
  Description of Artificial Sequence: Synthetic peptide
GFTFDDYA

SEQ ID NO: 370 - protein, 8 aa, Artificial Sequence
  Description of Artificial Sequence: Synthetic peptide
GFTFADFT

SEQ ID NO: 371 - protein, 8 aa, Artificial Sequence
  Description of Artificial Sequence: Synthetic peptide
GFTFDDYA

SEQ ID NO: 372 - protein, 8 aa, Artificial Sequence
  Description of Artificial Sequence: Synthetic peptide
GFTFDDFT

SEQ ID NO: 373 - protein, 8 aa, Artificial Sequence
  Description of Artificial Sequence: Synthetic peptide
GFTFDDYA

SEQ ID NO: 374 - protein, 8 aa, Artificial Sequence
  Description of Artificial Sequence: Synthetic peptide
GLTFSTYV

SEQ ID NO: 375 - protein, 8 aa, Artificial Sequence
  Description of Artificial Sequence: Synthetic peptide
GYTFTGYY

SEQ ID NO: 376 - protein, 8 aa, Artificial Sequence
  Description of Artificial Sequence: Synthetic peptide
GFTFDDYT

SEQ ID NO: 377 - protein, 8 aa, Artificial Sequence
  Description of Artificial Sequence: Synthetic peptide
GFTFSYYG

SEQ ID NO: 378 - protein, 8 aa, Artificial Sequence
  Description of Artificial Sequence: Synthetic peptide
GYTLSGYY

SEQ ID NO: 379 - protein, 8 aa, Artificial Sequence
  Description of Artificial Sequence: Synthetic peptide
GFTFSSYG

SEQ ID NO: 380 - protein, 8 aa, Artificial Sequence
  Description of Artificial Sequence: Synthetic peptide
GYTFTGYY

SEQ ID NO: 381 - protein, 8 aa, Artificial Sequence
  Description of Artificial Sequence: Synthetic peptide
GYSFIGYY

SEQ ID NO: 382 - protein, 8 aa, Artificial Sequence
  Description of Artificial Sequence: Synthetic peptide
GYTFTGYY

SEQ ID NO: 383 - protein, 8 aa, Artificial Sequence
  Description of Artificial Sequence: Synthetic peptide
GYTFTGYY

SEQ ID NO: 384 - protein, 8 aa, Artificial Sequence
  Description of Artificial Sequence: Synthetic peptide
GFTFSSYD

SEQ ID NO: 385 - protein, 8 aa, Artificial Sequence
  Description of Artificial Sequence: Synthetic peptide
GYTFIGYY

SEQ ID NO: 386 - protein, 8 aa, Artificial Sequence
  Description of Artificial Sequence: Synthetic peptide
GFTFDDYA

SEQ ID NO: 387 - protein, 8 aa, Artificial Sequence
  Description of Artificial Sequence: Synthetic peptide
GFTFGDYT

SEQ ID NO: 388 - protein, 8 aa, Artificial Sequence
  Description of Artificial Sequence: Synthetic peptide
GFTFADYT

SEQ ID NO: 389 - protein, 8 aa, Artificial Sequence
  Description of Artificial Sequence: Synthetic peptide
GFPFNDYT

SEQ ID NO: 390 - protein, 8 aa, Artificial Sequence
  Description of Artificial Sequence: Synthetic peptide
GFTFADYT

SEQ ID NO: 391 - protein, 8 aa, Artificial Sequence
  Description of Artificial Sequence: Synthetic peptide
GFTFADYT

SEQ ID NO: 392 - protein, 8 aa, Artificial Sequence
  Description of Artificial Sequence: Synthetic peptide
GFAFNDYT

SEQ ID NO: 393 - protein, 8 aa, Artificial Sequence
  Description of Artificial Sequence: Synthetic peptide
GFKFDDYT

SEQ ID NO: 394 - protein, 8 aa, Artificial Sequence
  Description of Artificial Sequence: Synthetic peptide
GFKFADYT

SEQ ID NO: 395 - protein, 8 aa, Artificial Sequence
  Description of Artificial Sequence: Synthetic peptide
GFTFDDYS

SEQ ID NO: 396 - protein, 8 aa, Artificial Sequence
  Description of Artificial Sequence: Synthetic peptide
GFTFADYT

SEQ ID NO: 397 - protein, 8 aa, Artificial Sequence
  Description of Artificial Sequence: Synthetic peptide
GFTFSDYT

SEQ ID NO: 398 - protein, 8 aa, Artificial Sequence
  Description of Artificial Sequence: Synthetic peptide
GFTFDDYT

SEQ ID NO: 399 - protein, 8 aa, Artificial Sequence
  Description of Artificial Sequence: Synthetic peptide
GFTFADYT

SEQ ID NO: 400 - protein, 8 aa, Artificial Sequence
  Description of Artificial Sequence: Synthetic peptide
GFTFADYT

SEQ ID NO: 401 - protein, 8 aa, Artificial Sequence
  Description of Artificial Sequence: Synthetic peptide
GFTFDDYT

SEQ ID NO: 402 - protein, 8 aa, Artificial Sequence
  Description of Artificial Sequence: Synthetic peptide
GFTFDDYT

SEQ ID NO: 403 - protein, 8 aa, Artificial Sequence
  Description of Artificial Sequence: Synthetic peptide
GFTFADYT

SEQ ID NO: 404 - protein, 8 aa, Artificial Sequence
  Description of Artificial Sequence: Synthetic peptide
GFKFDGYT

SEQ ID NO: 405 - protein, 8 aa, Artificial Sequence
  Description of Artificial Sequence: Synthetic peptide
GFTFDDYT

SEQ ID NO: 406 - protein, 8 aa, Artificial Sequence
  Description of Artificial Sequence: Synthetic peptide
GFKFDDYT

SEQ ID NO: 407 - protein, 8 aa, Artificial Sequence
  Description of Artificial Sequence: Synthetic peptide
GFSFINAW

SEQ ID NO: 408 - protein, 8 aa, Artificial Sequence
  Description of Artificial Sequence: Synthetic peptide
GFTFDDYS

SEQ ID NO: 409 - protein, 8 aa, Artificial Sequence
  Description of Artificial Sequence: Synthetic peptide
GFTFDDYS

SEQ ID NO: 410 - protein, 8 aa, Artificial Sequence
  Description of Artificial Sequence: Synthetic peptide
GFTFDDYS

SEQ ID NO: 411 - protein, 8 aa, Artificial Sequence
  Description of Artificial Sequence: Synthetic peptide
ISWNSGSI

SEQ ID NO: 412 - protein, 8 aa, Artificial Sequence
  Description of Artificial Sequence: Synthetic peptide
ISWNSGSI

SEQ ID NO: 413 - protein, 8 aa, Artificial Sequence
  Description of Artificial Sequence: Synthetic peptide
ISWNSGSK

SEQ ID NO: 414 - protein, 8 aa, Artificial Sequence
  Description of Artificial Sequence: Synthetic peptide
ISWNSGSL

SEQ ID NO: 415 - protein, 8 aa, Artificial Sequence
  Description of Artificial Sequence: Synthetic peptide
ISWNSGSI

SEQ ID NO: 416 - protein, 8 aa, Artificial Sequence
  Description of Artificial Sequence: Synthetic peptide
ISWNSGSK

SEQ ID NO: 417 - protein, 8 aa, Artificial Sequence
  Description of Artificial Sequence: Synthetic peptide
ISYDGSNK

SEQ ID NO: 418 - protein, 8 aa, Artificial Sequence
  Description of Artificial Sequence: Synthetic peptide
ISWNSGSI

SEQ ID NO: 419 - protein, 8 aa, Artificial Sequence
  Description of Artificial Sequence: Synthetic peptide
ISWNSGSI

SEQ ID NO: 420 - protein, 8 aa, Artificial Sequence
  Description of Artificial Sequence: Synthetic peptide
IYYDGNNK

SEQ ID NO: 421 - protein, 8 aa, Artificial Sequence
  Description of Artificial Sequence: Synthetic peptide
IYYDGKNK

SEQ ID NO: 422 - protein, 8 aa, Artificial Sequence
  Description of Artificial Sequence: Synthetic peptide
VYYDGNNQ

SEQ ID NO: 423 - protein, 8 aa, Artificial Sequence
  Description of Artificial Sequence: Synthetic peptide
IYYDGNNK

SEQ ID NO: 424 - protein, 8 aa, Artificial Sequence
  Description of Artificial Sequence: Synthetic peptide
IYFDGKNK

SEQ ID NO: 425 - protein, 8 aa, Artificial Sequence
  Description of Artificial Sequence: Synthetic peptide
IYFDGKNK

SEQ ID NO: 426 - protein, 8 aa, Artificial Sequence
  Description of Artificial Sequence: Synthetic peptide
IYFDGKNK

SEQ ID NO: 427 - protein, 8 aa, Artificial Sequence
  Description of Artificial Sequence: Synthetic peptide
IYFDGKNK

SEQ ID NO: 428 - protein, 8 aa, Artificial Sequence
  Description of Artificial Sequence: Synthetic peptide
IYYDGKNK

SEQ ID NO: 429 - protein, 8 aa, Artificial Sequence
  Description of Artificial Sequence: Synthetic peptide
IYFDGKNK

SEQ ID NO: 430 - protein, 8 aa, Artificial Sequence
  Description of Artificial Sequence: Synthetic peptide
IYFDGKNK

SEQ ID NO: 431 - protein, 8 aa, Artificial Sequence
  Description of Artificial Sequence: Synthetic peptide
IYYDGNNK

SEQ ID NO: 432 - protein, 8 aa, Artificial Sequence
  Description of Artificial Sequence: Synthetic peptide
ISWNSRSI

SEQ ID NO: 433 - protein, 8 aa, Artificial Sequence
  Description of Artificial Sequence: Synthetic peptide
ISWNSGSI

SEQ ID NO: 434 - protein, 7 aa, Artificial Sequence
  Description of Artificial Sequence: Synthetic peptide
IDWDDDK

SEQ ID NO: 435 - protein, 8 aa, Artificial Sequence
  Description of Artificial Sequence: Synthetic peptide
IYYDGNNK

SEQ ID NO: 436 - protein, 8 aa, Artificial Sequence
  Description of Artificial Sequence: Synthetic peptide
IYFDGKNK

SEQ ID NO: 437 - protein, 8 aa, Artificial Sequence
  Description of Artificial Sequence: Synthetic peptide
IYFDGKNK

SEQ ID NO: 438 - protein, 8 aa, Artificial Sequence
  Description of Artificial Sequence: Synthetic peptide
IWYDGTNK

SEQ ID NO: 439 - protein, 8 aa, Artificial Sequence
  Description of Artificial Sequence: Synthetic peptide
ISWNSGTI

SEQ ID NO: 440 - protein, 8 aa, Artificial Sequence
  Description of Artificial Sequence: Synthetic peptide
ISWNSGSI

SEQ ID NO: 441 - protein, 8 aa, Artificial Sequence
  Description of Artificial Sequence: Synthetic peptide
ISWNGGTK

SEQ ID NO: 442 - protein, 8 aa, Artificial Sequence
  Description of Artificial Sequence: Synthetic peptide
ISWNSGSI

SEQ ID NO: 443 - protein, 8 aa, Artificial Sequence
  Description of Artificial Sequence: Synthetic peptide
ISWNSGSI

SEQ ID NO: 444 - protein, 8 aa, Artificial Sequence
  Description of Artificial Sequence: Synthetic peptide
ISWNGNTI

SEQ ID NO: 445 - protein, 8 aa, Artificial Sequence
  Description of Artificial Sequence: Synthetic peptide
IWYNGKNK

SEQ ID NO: 446 - protein, 8 aa, Artificial Sequence
  Description of Artificial Sequence: Synthetic peptide
ISGSGGIT

SEQ ID NO: 447 - protein, 8 aa, Artificial Sequence
  Description of Artificial Sequence: Synthetic peptide
ISWNSGSI

SEQ ID NO: 448 - protein, 8 aa, Artificial Sequence
  Description of Artificial Sequence: Synthetic peptide
ILHDGSYK

SEQ ID NO: 449 - protein, 8 aa, Artificial Sequence
  Description of Artificial Sequence: Synthetic peptide
IWYDGSNK

SEQ ID NO: 450 - protein, 8 aa, Artificial Sequence
  Description of Artificial Sequence: Synthetic peptide
ILHDGSNR

SEQ ID NO: 451 - protein, 8 aa, Artificial Sequence
  Description of Artificial Sequence: Synthetic peptide
ILHDGSNR

SEQ ID NO: 452 - protein, 8 aa, Artificial Sequence
  Description of Artificial Sequence: Synthetic peptide
ISYDGSNK

SEQ ID NO: 453 - protein, 8 aa, Artificial Sequence
  Description of Artificial Sequence: Synthetic peptide
ISYDGSNK

SEQ ID NO: 454 - protein, 8 aa, Artificial Sequence
  Description of Artificial Sequence: Synthetic peptide
ISYDGNYK

SEQ ID NO: 455 - protein, 8 aa, Artificial Sequence
  Description of Artificial Sequence: Synthetic peptide
ISWNSGSM

SEQ ID NO: 456 - protein, 8 aa, Artificial Sequence
  Description of Artificial Sequence: Synthetic peptide
ISWNSGSR

SEQ ID NO: 457 - protein, 8 aa, Artificial Sequence
  Description of Artificial Sequence: Synthetic peptide
ISWNGGSR

SEQ ID NO: 458 - protein, 8 aa, Artificial Sequence
  Description of Artificial Sequence: Synthetic peptide
ISWNSGSR

SEQ ID NO: 459 - protein, 8 aa, Artificial Sequence
  Description of Artificial Sequence: Synthetic peptide
ISWNSNSI

SEQ ID NO: 460 - protein, 8 aa, Artificial Sequence
  Description of Artificial Sequence: Synthetic peptide
ISWNGGSK

SEQ ID NO: 461 - protein, 8 aa, Artificial Sequence
  Description of Artificial Sequence: Synthetic peptide
ISWNSGSI

SEQ ID NO: 462 - protein, 8 aa, Artificial Sequence
  Description of Artificial Sequence: Synthetic peptide
ISWNSGSK

SEQ ID NO: 463 - protein, 8 aa, Artificial Sequence
  Description of Artificial Sequence: Synthetic peptide
IANDGSNK

SEQ ID NO: 464 - protein, 8 aa, Artificial Sequence
  Description of Artificial Sequence: Synthetic peptide
INPKSGGT

SEQ ID NO: 465 - protein, 8 aa, Artificial Sequence
  Description of Artificial Sequence: Synthetic peptide
ISWNSGSI

SEQ ID NO: 466 - protein, 8 aa, Artificial Sequence
  Description of Artificial Sequence: Synthetic peptide
ISFDGKNK

SEQ ID NO: 467 - protein, 8 aa, Artificial Sequence
  Description of Artificial Sequence: Synthetic peptide
INPKSGVT

SEQ ID NO: 468 - protein, 8 aa, Artificial Sequence
  Description of Artificial Sequence: Synthetic peptide
ISFDGSNK

SEQ ID NO: 469 - protein, 8 aa, Artificial Sequence
  Description of Artificial Sequence: Synthetic peptide
INPNSDVT

SEQ ID NO: 470 - protein, 8 aa, Artificial Sequence
  Description of Artificial Sequence: Synthetic peptide
INPKSGVT

SEQ ID NO: 471 - protein, 8 aa, Artificial Sequence
  Description of Artificial Sequence: Synthetic peptide
INPKSGGT

SEQ ID NO: 472 - protein, 8 aa, Artificial Sequence
  Description of Artificial Sequence: Synthetic peptide
INPNSDVT

SEQ ID NO: 473 - protein, 8 aa, Artificial Sequence
  Description of Artificial Sequence: Synthetic peptide
ISSSGNTI

SEQ ID NO: 474 - protein, 8 aa, Artificial Sequence
  Description of Artificial Sequence: Synthetic peptide
INPKSGGT

SEQ ID NO: 475 - protein, 8 aa, Artificial Sequence
  Description of Artificial Sequence: Synthetic peptide
ISGDGGST

SEQ ID NO: 476 - protein, 8 aa, Artificial Sequence
  Description of Artificial Sequence: Synthetic peptide
ISWNSGSK

SEQ ID NO: 477 - protein, 8 aa, Artificial Sequence
  Description of Artificial Sequence: Synthetic peptide
ISWNSGSI

SEQ ID NO: 478 - protein, 8 aa, Artificial Sequence
  Description of Artificial Sequence: Synthetic peptide
ISWNSGSK

SEQ ID NO: 479 - protein, 8 aa, Artificial Sequence
  Description of Artificial Sequence: Synthetic peptide
ISWNSGSK

SEQ ID NO: 480 - protein, 8 aa, Artificial Sequence
  Description of Artificial Sequence: Synthetic peptide
ISWNSGSK

SEQ ID NO: 481 - protein, 8 aa, Artificial Sequence
  Description of Artificial Sequence: Synthetic peptide
ISWNSNSK

SEQ ID NO: 482 - protein, 8 aa, Artificial Sequence
  Description of Artificial Sequence: Synthetic peptide
ISWNSGSK

SEQ ID NO: 483 - protein, 8 aa, Artificial Sequence
  Description of Artificial Sequence: Synthetic peptide
ISWNSGSK

SEQ ID NO: 484 - protein, 8 aa, Artificial Sequence
  Description of Artificial Sequence: Synthetic peptide
ISWNSGSK

SEQ ID NO: 485 - protein, 8 aa, Artificial Sequence
  Description of Artificial Sequence: Synthetic peptide
ISWNSGSM

SEQ ID NO: 486 - protein, 8 aa, Artificial Sequence
  Description of Artificial Sequence: Synthetic peptide
ISWNSGSK

SEQ ID NO: 487 - protein, 8 aa, Artificial Sequence
  Description of Artificial Sequence: Synthetic peptide
ISWNSGSR

SEQ ID NO: 488 - protein, 8 aa, Artificial Sequence
  Description of Artificial Sequence: Synthetic peptide
ISWNSGTR

SEQ ID NO: 489 - protein, 8 aa, Artificial Sequence
  Description of Artificial Sequence: Synthetic peptide
IGWNSNTI

SEQ ID NO: 490 - protein, 8 aa, Artificial Sequence
  Description of Artificial Sequence: Synthetic peptide
IGWNSNSI

SEQ ID NO: 491 - protein, 8 aa, Artificial Sequence
  Description of Artificial Sequence: Synthetic peptide
IGWNSNTK

SEQ ID NO: 492 - protein, 8 aa, Artificial Sequence
  Description of Artificial Sequence: Synthetic peptide
IGWSGGSL

SEQ ID NO: 493 - protein, 8 aa, Artificial Sequence
  Description of Artificial Sequence: Synthetic peptide
IGWNSNTI

SEQ ID NO: 494 - protein, 8 aa, Artificial Sequence
  Description of Artificial Sequence: Synthetic peptide
IGWNSNTI

SEQ ID NO: 495 - protein, 8 aa, Artificial Sequence
  Description of Artificial Sequence: Synthetic peptide
ISWSGGSI

SEQ ID NO: 496 - protein, 10 aa, Artificial Sequence
  Description of Artificial Sequence: Synthetic peptide
IKSISDGGTT

SEQ ID NO: 497 - protein, 8 aa, Artificial Sequence
  Description of Artificial Sequence: Synthetic peptide
ISWNSGSK

SEQ ID NO: 498 - protein, 8 aa, Artificial Sequence
  Description of Artificial Sequence: Synthetic peptide
ISWNSGSI

SEQ ID NO: 499 - protein, 8 aa, Artificial Sequence
  Description of Artificial Sequence: Synthetic peptide
ISWNSGSI

SEQ ID NO: 500 - protein, 16 aa, Artificial Sequence
  Description of Artificial Sequence: Synthetic peptide
AKDNSGYGYYYYGMDV

SEQ ID NO: 501 - protein, 17 aa, Artificial Sequence
  Description of Artificial Sequence: Synthetic peptide
AKDNSGYGYYYYYGMDV

SEQ ID NO: 502 - protein, 17 aa, Artificial Sequence
  Description of Artificial Sequence: Synthetic peptide
AKDMSGYAHYFYYGMDV

SEQ ID NO: 503 - protein, 17 aa, Artificial Sequence
  Description of Artificial Sequence: Synthetic peptide
VKDGSGYGHYSYYGLDV

SEQ ID NO: 504 - protein, 17 aa, Artificial Sequence
  Description of Artificial Sequence: Synthetic peptide
AKDMSGYAHYFYYGMDV

SEQ ID NO: 505 - protein, 17 aa, Artificial Sequence
  Description of Artificial Sequence: Synthetic peptide
AKDMSGYAHYYYYALDV

SEQ ID NO: 506 - protein, 14 aa, Artificial Sequence
  Description of Artificial Sequence: Synthetic peptide
AKEGGHDYGGTFDY

SEQ ID NO: 507 - protein, 16 aa, Artificial Sequence
  Description of Artificial Sequence: Synthetic peptide
AKDNSGYGHYYYGMDV

SEQ ID NO: 508 - protein, 16 aa, Artificial Sequence
  Description of Artificial Sequence: Synthetic peptide
AKDNSGYGHYYYGMDV

SEQ ID NO: 509 - protein, 11 aa, Artificial Sequence
  Description of Artificial Sequence: Synthetic peptide
ARGPGYNWLDP

SEQ ID NO: 510 - protein, 11 aa, Artificial Sequence
  Description of Artificial Sequence: Synthetic peptide
ARGPGYNWLDP

SEQ ID NO: 511 - protein, 11 aa, Artificial Sequence
  Description of Artificial Sequence: Synthetic peptide
ARGPGYNWLDP

SEQ ID NO: 512 - protein, 11 aa, Artificial Sequence
  Description of Artificial Sequence: Synthetic peptide
ARGPGYNWLDP

SEQ ID NO: 513 - protein, 11 aa, Artificial Sequence
  Description of Artificial Sequence: Synthetic peptide
ARGPGYNWLDP

SEQ ID NO: 514 - protein, 11 aa, Artificial Sequence
  Description of Artificial Sequence: Synthetic peptide
ARGPGYNWLDP

SEQ ID NO: 515 - protein, 11 aa, Artificial Sequence
  Description of Artificial Sequence: Synthetic peptide
ARGPGYNWLDP

SEQ ID NO: 516 - protein, 11 aa, Artificial Sequence
  Description of Artificial Sequence: Synthetic peptide
ARGPGYNWLDP

SEQ ID NO: 517 - protein, 11 aa, Artificial Sequence
  Description of Artificial Sequence: Synthetic peptide
ARGPGYNWLDP

SEQ ID NO: 518 - protein, 11 aa, Artificial Sequence
  Description of Artificial Sequence: Synthetic peptide
ARGPGYNWLDP

SEQ ID NO: 519 - protein, 11 aa, Artificial Sequence
  Description of Artificial Sequence: Synthetic peptide
ARGPGYNWLDP

SEQ ID NO: 520 - protein, 11 aa, Artificial Sequence
  Description of Artificial Sequence: Synthetic peptide
ARGPGYNWLDP

SEQ ID NO: 521 - protein, 17 aa, Artificial Sequence
  Description of Artificial Sequence: Synthetic peptide
VKDNSGYGRYYYYGMDV

SEQ ID NO: 522 - protein, 16 aa, Artificial Sequence
  Description of Artificial Sequence: Synthetic peptide
AKDNSGYGYYYYGMDV

SEQ ID NO: 523 - protein, 15 aa, Artificial Sequence
  Description of Artificial Sequence: Synthetic peptide
ARMDIVGARGGWFDP

SEQ ID NO: 524 - protein, 11 aa, Artificial Sequence
  Description of Artificial Sequence: Synthetic peptide
ARGPGYNWLDP

SEQ ID NO: 525 - protein, 11 aa, Artificial Sequence
  Description of Artificial Sequence: Synthetic peptide
ARGPGYNWLDP

SEQ ID NO: 526 - protein, 11 aa, Artificial Sequence
  Description of Artificial Sequence: Synthetic peptide
ARGPGYNWLDP

SEQ ID NO: 527 - protein, 10 aa, Artificial Sequence
  Description of Artificial Sequence: Synthetic peptide
ARDRGSIITH

SEQ ID NO: 528 - protein, 17 aa, Artificial Sequence
  Description of Artificial Sequence: Synthetic peptide
AKDMSGYAHYYYYGMDV

SEQ ID NO: 529 - protein, 17 aa, Artificial Sequence
  Description of Artificial Sequence: Synthetic peptide
AKDMSGYAHYGYYGMDV

SEQ ID NO: 530 - protein, 16 aa, Artificial Sequence
  Description of Artificial Sequence: Synthetic peptide
VKDKSGYGHFYFGLDV

SEQ ID NO: 531 - protein, 16 aa, Artificial Sequence
  Description of Artificial Sequence: Synthetic peptide
VKDKSGYGHYYIGMDV

SEQ ID NO: 532 - protein, 17 aa, Artificial Sequence
  Description of Artificial Sequence: Synthetic peptide
AKDMSGYGHYGKYGMDV

SEQ ID NO: 533 - protein, 17 aa, Artificial Sequence
  Description of Artificial Sequence: Synthetic peptide
AKDKSGYGHFYYYVLDV

SEQ ID NO: 534 - protein, 14 aa, Artificial Sequence
  Description of Artificial Sequence: Synthetic peptide
ARDGVSARGTPFDY

SEQ ID NO: 535 - protein, 14 aa, Artificial Sequence
  Description of Artificial Sequence: Synthetic peptide
AKGPYLTTVTPFDY

SEQ ID NO: 536 - protein, 16 aa, Artificial Sequence
  Description of Artificial Sequence: Synthetic peptide
VKDNSGYASYYYGMDV

SEQ ID NO: 537 - protein, 19 aa, Artificial Sequence
  Description of Artificial Sequence: Synthetic peptide
AKGPMFRGVPYNHYYGMDV

SEQ ID NO: 538 - protein, 12 aa, Artificial Sequence
  Description of Artificial Sequence: Synthetic peptide
VRDQAALYYFDS

SEQ ID NO: 539 - protein, 19 aa, Artificial Sequence
  Description of Artificial Sequence: Synthetic peptide
TKGAMVRGVPYNHYYGMDV

SEQ ID NO: 540 - protein, 19 aa, Artificial Sequence
  Description of Artificial Sequence: Synthetic peptide
TKGAMVRGVPYNHYYGMDV

SEQ ID NO: 541 - protein, 19 aa, Artificial Sequence
  Description of Artificial Sequence: Synthetic peptide
AKGAMVRGVPYNYYYGMDV

SEQ ID NO: 542 - protein, 19 aa, Artificial Sequence
  Description of Artificial Sequence: Synthetic peptide
AKGAMVRGVPYNYYYGMDV

SEQ ID NO: 543 - protein, 19 aa, Artificial Sequence
  Description of Artificial Sequence: Synthetic peptide
AKGAMVRGVPYNFYYGMDV

SEQ ID NO: 544 - protein, 16 aa, Artificial Sequence
  Description of Artificial Sequence: Synthetic peptide
AKDKSGYGSFYYGMDV

SEQ ID NO: 545 - protein, 16 aa, Artificial Sequence
  Description of Artificial Sequence: Synthetic peptide
AKDKSGYGSYFYGMDV

SEQ ID NO: 546 - protein, 16 aa, Artificial Sequence
  Description of Artificial Sequence: Synthetic peptide
AKDKSGYGSYFYGMDV

SEQ ID NO: 547 - protein, 16 aa, Artificial Sequence
  Description of Artificial Sequence: Synthetic peptide
AKDKSGYGSYYYGMDV

SEQ ID NO: 548 - protein, 16 aa, Artificial Sequence
  Description of Artificial Sequence: Synthetic peptide
VKDRSGYSRFYYGMDV

SEQ ID NO: 549 - protein, 16 aa, Artificial Sequence
  Description of Artificial Sequence: Synthetic peptide
AKDKSGYGSFYYGLDV

SEQ ID NO: 550 - protein, 16 aa, Artificial Sequence
  Description of Artificial Sequence: Synthetic peptide
IKDKSGYGSYNYGLDV

SEQ ID NO: 551 - protein, 16 aa, Artificial Sequence
  Description of Artificial Sequence: Synthetic peptide
AKDKSGYGSFYYGMDV

SEQ ID NO: 552 - protein, 17 aa, Artificial Sequence
  Description of Artificial Sequence: Synthetic peptide
AKEGGTSGSYYYYGMDV

SEQ ID NO: 553 - protein, 11 aa, Artificial Sequence
  Description of Artificial Sequence: Synthetic peptide
ARMGDGAVFDF

SEQ ID NO: 554 - protein, 16 aa, Artificial Sequence
  Description of Artificial Sequence: Synthetic peptide
AKDQSGYGHYYYGMDV

SEQ ID NO: 555 - protein, 22 aa, Artificial Sequence
  Description of Artificial Sequence: Synthetic peptide
ARSYDILTGYGAGYSYHYGMDV

SEQ ID NO: 556 - protein, 11 aa, Artificial Sequence
  Description of Artificial Sequence: Synthetic peptide
ARMGDGAVFDF

SEQ ID NO: 557 - protein, 17 aa, Artificial Sequence
  Description of Artificial Sequence: Synthetic peptide
AKGGGTSGSYFYYGMDV

SEQ ID NO: 558 - protein, 11 aa, Artificial Sequence
  Description of Artificial Sequence: Synthetic peptide
ARMGDGAVFDY

SEQ ID NO: 559 - protein, 11 aa, Artificial Sequence
  Description of Artificial Sequence: Synthetic peptide
ARMGDGAVFDF

SEQ ID NO: 560 - protein, 11 aa, Artificial Sequence
  Description of Artificial Sequence: Synthetic peptide
ARMGDGAVFDF

SEQ ID NO: 561 - protein, 11 aa, Artificial Sequence
  Description of Artificial Sequence: Synthetic peptide
ARMGDGAVFDY

SEQ ID NO: 562 - protein, 20 aa, Artificial Sequence
  Description of Artificial Sequence: Synthetic peptide
AKAGPATVTRRYYYYYGLDV

SEQ ID NO: 563 - protein, 11 aa, Artificial Sequence
  Description of Artificial Sequence: Synthetic peptide
ARMGDGAMFDY

SEQ ID NO: 564 - protein, 18 aa, Artificial Sequence
  Description of Artificial Sequence: Synthetic peptide
AKDDSSSSWYYYYYGMDV

SEQ ID NO: 565 - protein, 17 aa, Artificial Sequence
  Description of Artificial Sequence: Synthetic peptide
AKDSRGYGLYYHLGLDV

SEQ ID NO: 566 - protein, 17 aa, Artificial Sequence
  Description of Artificial Sequence: Synthetic peptide
AKDSRGYGHYKYLGLDV

SEQ ID NO: 567 - protein, 17 aa, Artificial Sequence
  Description of Artificial Sequence: Synthetic peptide
VKDGSGYGRFHYYAMDV

SEQ ID NO: 568 - protein, 17 aa, Artificial Sequence
  Description of Artificial Sequence: Synthetic peptide
VKYGSGYGKFYFYAMDV

SEQ ID NO: 569 - protein, 17 aa, Artificial Sequence
  Description of Artificial Sequence: Synthetic peptide
AKYGSGYGRYFFYAMDV

SEQ ID NO: 570 - protein, 17 aa, Artificial Sequence
  Description of Artificial Sequence: Synthetic peptide
VKDGSGYGKFSLYALDV

SEQ ID NO: 571 - protein, 17 aa, Artificial Sequence
  Description of Artificial Sequence: Synthetic peptide
AKDKSGYGHFYYYAMDV

SEQ ID NO: 572 - protein, 17 aa, Artificial Sequence
  Description of Artificial Sequence: Synthetic peptide
AKDGSGYGRFHFYAIDV

SEQ ID NO: 573 - protein, 17 aa, Artificial Sequence
  Description of Artificial Sequence: Synthetic peptide
AKYGSGYGKFYHYGLDV

SEQ ID NO: 574 - protein, 17 aa, Artificial Sequence
  Description of Artificial Sequence: Synthetic peptide
AKDGSGYGKYFFYAMDV

SEQ ID NO: 575 - protein, 17 aa, Artificial Sequence
  Description of Artificial Sequence: Synthetic peptide
VKDGSGYGKYHFYAMDV

SEQ ID NO: 576 - protein, 17 aa, Artificial Sequence
  Description of Artificial Sequence: Synthetic peptide
AKDKSGYGHYYYYAMDV

SEQ ID NO: 577 - protein, 17 aa, Artificial Sequence
  Description of Artificial Sequence: Synthetic peptide
VKDGSGYGRYNFYAMDV

SEQ ID NO: 578 - protein, 16 aa, Artificial Sequence
  Description of Artificial Sequence: Synthetic peptide
VKDKSGYGKFQYGLDV

SEQ ID NO: 579 - protein, 16 aa, Artificial Sequence
  Description of Artificial Sequence: Synthetic peptide
VKDKSGYGKFFIGLDV

SEQ ID NO: 580 - protein, 16 aa, Artificial Sequence
  Description of Artificial Sequence: Synthetic peptide
VKDKSGYGKFFIGLDV

SEQ ID NO: 581 - protein, 16 aa, Artificial Sequence
  Description of Artificial Sequence: Synthetic peptide
VKDKSGYGKFQYGLDV

SEQ ID NO: 582 - protein, 16 aa, Artificial Sequence
  Description of Artificial Sequence: Synthetic peptide
VKDKSGYGKFFIGLDV

SEQ ID NO: 583 - protein, 16 aa, Artificial Sequence
  Description of Artificial Sequence: Synthetic peptide
VKDKSGYGKFQYGLDV

SEQ ID NO: 584 - protein, 16 aa, Artificial Sequence
  Description of Artificial Sequence: Synthetic peptide
VKDKSGYGKYSYGLDV

SEQ ID NO: 585 - protein, 10 aa, Artificial Sequence
  Description of Artificial Sequence: Synthetic peptide
TTEVARTPNY

SEQ ID NO: 586 - protein, 17 aa, Artificial Sequence
  Description of Artificial Sequence: Synthetic peptide
AKYGSGYGKFYHYGLDV

SEQ ID NO: 587 - protein, 17 aa, Artificial Sequence
  Description of Artificial Sequence: Synthetic peptide
AKDGSGYGYFYYYGMDV

SEQ ID NO: 588 - protein, 17 aa, Artificial Sequence
  Description of Artificial Sequence: Synthetic peptide
AKDGSGYGKFYYYGMDV

SEQ ID NO: 589 - protein, 107 aa, Artificial Sequence
  Description of Artificial Sequence: Synthetic polypeptide
EIVMTQSPATLSVSPGERATLSCRASHSVSRNSAWYQQKPGQAPRLLIYGASTRATGIPARFSGSGSGTEFTLTISSLQSEDFAIYYCQQYNNWPLTFGGGTKVEIK

SEQ ID NO: 590 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYYNWPLTFGGGTKVEIK

SEQ ID NO: 591 - protein, 108 aa, Artificial Sequence
  Description of Artificial Sequence: Synthetic polypeptide
DIQMTQSPSSLSASVGDRVTITCRPSQSISSYLNWFQQKPGKAPKLLIYAASSLQSGVPSRFSGSGSGTDFTLTISSLQPEDFATYYCQQSYSTPPITFGQGTRLEIK

SEQ ID NO: 592 - protein, 108 aa, Artificial Sequence; identical to SEQ ID NO: 125
  Description of Artificial Sequence: Synthetic polypeptide

SEQ ID NO: 593 - protein, 108 aa, Artificial Sequence
  Description of Artificial Sequence: Synthetic polypeptide
DIQMTQSPSSLSASVGDRVTITCRASQSISSYLNWYQQKPGKAPKLLIFAASSLQSGVPSRFSGSGSGTDFTLTISSLQPEDFATYYCQQSYSTPPITFGQGTRLEIK

SEQ ID NO: 594 - protein, 108 aa, Artificial Sequence
  Description of Artificial Sequence: Synthetic polypeptide
DIQMTQSPSSLSASVGDRVTITCRASQSISNYLNWYQQKPGKAPKLLIYAASSLQSGVPSRFSGSGSGTDFTLTISSLQPEDFATYYCQQSYSNPPITFGQGTRLEIK

SEQ ID NO: 595 - protein, 107 aa, Artificial Sequence
  Description of Artificial Sequence: Synthetic polypeptide
DIQMTQSPSSLSASVGDRVTITCQASQDINNYLNWYQQKPGKAPKFLIYDASNLETGVPSRFSGSGSGTDFTFTISSLQPEDIATYYCQQYDDLPFTFGPGTKVDIK

SEQ ID NO: 596 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQHYINWPLTFGGGTKVEIK

SEQ ID NO: 597 - protein, 107 aa, Artificial Sequence; identical to SEQ ID NO: 596
  Description of Artificial Sequence: Synthetic polypeptide

SEQ ID NO: 598 - protein, 107 aa, Artificial Sequence
  Description of Artificial Sequence: Synthetic polypeptide
  MOD_RES (38)..(38): Any amino acid
EIVMTQSPATLSVSPGERATLSCRASQSISRNLAWYQXKPGQAPRLLIYGASTRATGIPARFSGSGSGTEFTLTISSLQSEDFAVYYCQQYNNRPLTFGGGTEVEIK

SEQ ID NO: 599 - protein, 107 aa, Artificial Sequence
  Description of Artificial Sequence: Synthetic polypeptide
EIVMTQSPATLSVSPGERATLSCRASQRISSNLAWYQQKPGQAPRLLIYGASTRATGSPARFSGSGSGTDFTLTISSLQSEDVAVYYCQQHHNWPLTFGGGTKVEIK

SEQ ID NO: 600 - protein, 107 aa, Artificial Sequence
  Description of Artificial Sequence: Synthetic polypeptide
EIVMTQSPATLSVSPGERATLSCRASQSVSRNLAWYQQKPGQAPRLLIYGASTRATGIPARFSGSGSGTDFTLTISSLQSEDFAVYYCQQYNNWPLTFGGGTKVVIK

SEQ ID NO: 601 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYNNRPLTFGGGTKVEIK

SEQ ID NO: 602 - protein, 107 aa, Artificial Sequence
  Description of Artificial Sequence: Synthetic polypeptide
EIVMTQSPATLSVSPGERVTLSCRASQSISRNLAWYQQKPGQAPRLLIYGASTRATGVPARFSGSGSGTEFTLTISSLQSEDFAVFHCQQYNNRPLTFGGGTEVEIK

SEQ ID NO: 603 - protein, 107 aa, Artificial Sequence
  Description of Artificial Sequence: Synthetic polypeptide
  MOD_RES (38)..(38): Any amino acid
EIVMTQSPATLSVSPGERVTLSCRASQSISRNLAWYQXKPGQAPRLLIYGASTRATGVPARFSGSGSGTEFTLTISSLQSEDFAVFHCQQYNNRPLTFGGGTEVEIK

SEQ ID NO: 604 - protein, 107 aa, Artificial Sequence
  Description of Artificial Sequence: Synthetic polypeptide
EIVMTQSPATLSVSPGERATLSCRASQSVSRNLAWYQQKPGQAPRLLIYGASTRATGVPARFSGSGSGTEFTLTISSLQSEDFAVFHCQQYNNRPLTFGGGTEVEIK

SEQ ID NO: 605 - protein, 107 aa, Artificial Sequence; identical to SEQ ID NO: 604
  Description of Artificial Sequence: Synthetic polypeptide

SEQ ID NO: 606 - protein, 107 aa, Artificial Sequence
  Description of Artificial Sequence: Synthetic polypeptide
EIVMTQSPATLSVSPGERATLSCRASQRISSNLAWYQQKPGQAPRLLIYGASTRATGSPARFSGSGSGTEFTLTISSLQSEDVAVYYCQQHNNWPLTFGGGTKVEIK

SEQ ID NO: 607 - protein, 107 aa, Artificial Sequence
  Description of Artificial Sequence: Synthetic polypeptide
EIVMTQSPATLSVSPGERVILSCRASQSISRNLAWYQQKPGQAPRLLIYGATTRATGVPARFSGSGSGTEFTLTISSLQSEDFAVFYCQQYNNRPLTFGGGTEVEIK

SEQ ID NO: 608 - protein, 107 aa, Artificial Sequence
  Description of Artificial Sequence: Synthetic polypeptide
  MOD_RES (38)..(38): Any amino acid
EIVMTQSPATLSVSPGERVILSCRASQSISRNLAWYQXKPGQAPRLLIYGATTRATGVPARFSGSGSGTEFTLTISSLQSEDFAVFYCQQYNNRPLTFGGGTEVEIK

SEQ ID NO: 609 - protein, 107 aa, Artificial Sequence; identical to SEQ ID NO: 601
  Description of Artificial Sequence: Synthetic polypeptide

SEQ ID NO: 610 - protein, 107 aa, Artificial Sequence
  Description of Artificial Sequence: Synthetic polypeptide
KIVMTQSPATLSVSPGERATLSCRASQSVSGNLAWYQQKPGQAPRLLIYGASTRATSIPARFSGSGSGTEFTLTISSLQSEDFAVYFCQHYYNWPLTFGGGTKVEIR

SEQ ID NO: 611 - protein, 113 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKLEIK

SEQ ID NO: 612 - protein, 107 aa, Artificial Sequence
  Description of Artificial Sequence: Synthetic polypeptide
DIQMTQSPSSLSASVGDRVTITCRASQGISNYLAWFQQKPGKAPKSLIYAASSLQSGVPSKFSGSGSGTDFTLTISSLQPEDFATYYCQQYNSYPLTFGGGTKVEIK

SEQ ID NO: 613 - protein, 107 aa, Artificial Sequence
  Description of Artificial Sequence: Synthetic polypeptide
EIVMTQSPATLSVSPGERATLSCRASQSVSRNLAWYQQKPGQAPRLLIYGASTRATDIPARFSGSGSGTEFILNISSLQSEDFALYYCQQYSNWPLTFGGGTEVEIK

SEQ ID NO: 614 - protein, 107 aa, Artificial Sequence; identical to SEQ ID NO: 607
  Description of Artificial Sequence: Synthetic polypeptide

SEQ ID NO: 615 - protein, 107 aa, Artificial Sequence; identical to SEQ ID NO: 607
  Description of Artificial Sequence: Synthetic polypeptide

SEQ ID NO: 616 - protein, 108 aa, Artificial Sequence
  Description of Artificial Sequence: Synthetic polypeptide
DIQMTQSPSSLSASIGDRVTITCRASQNISSYLNWYQQKPGKAPKLLIYAASSLQSGVPSRFSGSGSGTDFTLTISSLQPEDFATYYCQQTYSTPPITFGQGTRLEIK

SEQ ID NO: 617 - protein, 108 aa, Artificial Sequence; identical to SEQ ID NO: 123
  Description of Artificial Sequence: Synthetic polypeptide

SEQ ID NO: 618 - protein, 108 aa, Artificial Sequence
  Description of Artificial Sequence: Synthetic polypeptide
DIQMTQSPSSLSASVGDRVTITCRASQSIRNYLNWYQQKPGKVPKLLIYAASSLQSGVPSRFSGSGSGTDFTLTISSLQPEDFATYYCQQSYSNPPITFGQGTRLEIK

SEQ ID NO: 619 - protein, 108 aa, Artificial Sequence
  Description of Artificial Sequence: Synthetic polypeptide
DIQMTQSPSSLTASVGDRVTFTCRASQSISRHLSWYQQKPGKAPKLLIYAASSLESGVPSRFSGSGSGTDFTLTISSLHPEDFATYYCQQSYSNPPITFGQGTRLEIK

SEQ ID NO: 620 - protein, 108 aa, Artificial Sequence; identical to SEQ ID NO: 123
  Description of Artificial Sequence: Synthetic polypeptide

SEQ ID NO: 621 - protein, 108 aa, Artificial Sequence
  Description of Artificial Sequence: Synthetic polypeptide
DIQMTQSPSSLSASVGDRVTITCRASQSIRSYLNWYQQKPGKVPKLLIYAASSLQSGVPSRFSGSGSGTDFTLTINSLQPDDFATYYCQQTYSNPPITFGQGTRLEIK

SEQ ID NO: 622 - protein, 107 aa, Artificial Sequence
  Description of Artificial Sequence: Synthetic polypeptide
DIQMTQSPSSLSASVGDRVTITCRASQSINNYLNWYQQKPGKAPKLLIYAASSLQSGVPSRFSGSGSGTDFTLTISSLQPEDFATYYSQQSYSFPWTFGQGTKVEIK

SEQ ID NO: 623 - protein, 107 aa, Artificial Sequence
  Description of Artificial Sequence: Synthetic polypeptide
ETTLTQSPAFMSAAPGDKVSISCIASQYIDDDVNWYQQKPGETAIFIIQEASTLVPGISPRFSGSGYGTHFTLTINNIDSEDAAFYFCLQHDNFPYTFGQGTKLEIK

SEQ ID NO: 624 - protein, 108 aa, Artificial Sequence
  Description of Artificial Sequence: Synthetic polypeptide
DIQLTQSPSSVSASVGDRVTITCRASQGISSWLAWYQQKPGKAPKLLIYAVSSLQNGVPSRFSGSGSGTDFTLTISSLQPEDFATYYCQQANSFPFTFGPGTKLEIKR

SEQ ID NO: 625 - protein, 108 aa, Artificial Sequence
  Description of Artificial Sequence: Synthetic polypeptide
DIQLTQSPSSLSASVGDRVTITCRASQSISSYLNWYQQKPGKAPKLLIYDASNLETGVPSRFSGSGSGTDFTFTISSLQPEDIATYYCQQYDNLPFTFGPGTKVDIKR

SEQ ID NO: 626 - protein, 108 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVSSRFSGSGSGTEFTLTISSLQPEDFATYYCLQHNSYPYTFGQGTKVEIKR

SEQ ID NO: 627 - protein, 108 aa, Artificial Sequence
  Description of Artificial Sequence: Synthetic polypeptide
DIQMTQSPSSVSASVGDRVTITCRASQGISRWLAWYQQKPGKAPKLLISAASSLQSGVPSRFSGSGSGTDFTLTISGLQPEDFATYYCQKANSFPFTFGPGTKLEIKR

SEQ ID NO: 628 - protein, 108 aa, Artificial Sequence
  Description of Artificial Sequence: Synthetic polypeptide
DIQMTQSPSSLSASVGDRVTITCRASQGIRNDLGWYQQKPGKAPKRLIYAASILQSGVPSRFSGSGSGTEFTLTISSLQPEDFATYYCLQHNSYPYTFGQGTKLEIKR

SEQ ID NO: 629 - protein, 108 aa, Artificial Sequence
  Description of Artificial Sequence: Synthetic polypeptide
DIVMTQSPSSLSASVGDRVTITCRASQGIRNDLGWYQQKPGKAPKRLIYAASNLQSGVPSRFSGSGSGTEFTLTISSLQPEDFATYYCLQHNSYPYTFGQGTKLEIKR

SEQ ID NO: 630 - protein, 107 aa, Artificial Sequence
  Description of Artificial Sequence: Synthetic polypeptide
DIQMTQSPSSLSASVGDRVTITCRASQGIRNDLGWFQQKPGKAPKRLIYAASSLQSGVPSRFSGSGSGTEFTLTISSLQPEDFATYYCLQHNSYPYTFGQGTKLEIK

SEQ ID NO: 631 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPYTFGQGTKLEIK

SEQ ID NO: 632 - protein, 107 aa, Artificial Sequence
  Description of Artificial Sequence: Synthetic polypeptide
DIQMTQSPSSLSASVGDRVTITCRASQVIRNDLGWYQQKPGKAPKRLIYAASSLQSGIPSRFSGSGSGTEFTLTISSLQPEDFATYYCLQHNSYPYTFGQGTKLEIK

SEQ ID NO: 633 - protein, 108 aa, Artificial Sequence
  Description of Artificial Sequence: Synthetic polypeptide
EIVLTQSPGTLSLSPGDRATLSCRASQSVSSIYLAWYQQKPGQAPRLLIHGASTRATGIPDRFSGSGSGTDFTLTISRLEPEDFAVYYCQQRAHSPYTFGQGTKLEIK

SEQ ID NO: 634 - protein, 108 aa, Artificial Sequence
  Description of Artificial Sequence: Synthetic polypeptide
EIVLTQSPGTLSLSPGDRATLSCRASQSIRNIYLAWYQQKPGQAPRLLIHGASTRATGIPDRFSGSGSGTDFTLTISRLEPEDFAVYYCQQRVSLPYTFGQGTKLEIK

SEQ ID NO: 635 - protein, 108 aa, Artificial Sequence
  Description of Artificial Sequence: Synthetic polypeptide
EIVLTQSPGILSLSPGDRATLSCRASQSIRNIYLAWYQQKPGQAPRLLIHGASTRATGIPDRFSGSGSGTDFTLTISRLEPEDFAVYYCQQRVSSPYTFGQGTKLEIK

SEQ ID NO: 636 - protein, 108 aa, Artificial Sequence
  Description of Artificial Sequence: Synthetic polypeptide
EIVLTQSPGTLSLSPGDRATLSCRASQSIRSIYLAWYQQKPGQAPRLLIHGASTRATGIPDRFSGSGSGTDFTLTISRLEPEDFAVYYCQQRVSSPYTFGQGTKLEIK

SEQ ID NO: 637 - protein, 107 aa, Artificial Sequence
  Description of Artificial Sequence: Synthetic polypeptide
EIVMTQSPATLSVSPGERAILSCRASQNINSNLAWYQQKPGQAPRLLIYGASTRATGVPARFSGSGSGTEFTLTIRSLQSEDFAVYYCQQYYNWPITFGHGTRLEIK

SEQ ID NO: 638 - protein, 108 aa, Artificial Sequence; identical to SEQ ID NO: 636
  Description of Artificial Sequence: Synthetic polypeptide

SEQ ID NO: 639 - protein, 108 aa, Artificial Sequence
  Description of Artificial Sequence: Synthetic polypeptide
EIVLTQSPGTLSLSPGDRATLSCRASQSVSSIYLAWYQQKPGQAPRLLIHGASTRATGIPDRFSGSGSGTDFTLTISRLEPEDFALYYCHQRVSSPYTFGQGTKLEIK

SEQ ID NO: 640 - protein, 106 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFSGSGSGTEFTLTISSLQPDDFATYYCQQYNSYSPFGQGTKVEIK

SEQ ID NO: 641 - protein, 114 aa, Artificial Sequence
  Description of Artificial Sequence: Synthetic polypeptide
DIQMTQSPDSLAVSLGERATINCKSSQSLLFNSINKNYLAWYQQKPGQPPKLLLYWASTRESGIPDRFSGSGSGTDFTLTITSLQAEDVALYYCQQYYSIPWTFGQGTKVEIKR

SEQ ID NO: 642 - protein, 108 aa, Artificial Sequence
  Description of Artificial Sequence: Synthetic polypeptide
AIQMTQSPSSLSASVGDRVTITCRASQRISSFLNWYQQKPGKAPKLLIYTASNLQNGVPSRFSGSGSGTDFTLTISSLQPEDFATYYCQQSYRTPLTFGGGTKVEIKR

SEQ ID NO: 643 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATDIPARFSGSGSGTEFTLTISSLQSEDFAVYHCQQYNNWPLTFGGGTKVEIK

SEQ ID NO: 644 - protein, 108 aa, Artificial Sequence; identical to SEQ ID NO: 642
  Description of Artificial Sequence: Synthetic polypeptide

SEQ ID NO: 645 - protein, 108 aa, Artificial Sequence
  Description of Artificial Sequence: Synthetic polypeptide
DIQLTQSPSSLSASVGDRVTITCRASQRISSFLNWYQQKPGKAPKLLIYTASNLQNGVPSRFSGSGSGTDFTLTISSLQPEDFATYYCQQSYRTPLTFGGGTKLEIKR

SEQ ID NO: 646 - protein, 108 aa, Artificial Sequence
  Description of Artificial Sequence: Synthetic polypeptide
AIQMTQSPSSLSASVGDRVTITCRASQRISSFLNWYQQKPGKAPKLLIYTASNLQNGVPSRFSGSGSGTDFTLTISSLQPEDFATYYCQQSYRTPLTFGGGTKLEIKR

SEQ ID NO: 647 - protein, 108 aa, Artificial Sequence
  Description of Artificial Sequence: Synthetic polypeptide
DIQLTQSPSSLSASVGDRVTITCRASQRISSYLNWYQQKPGKAPKVLISVASSLQSGVPSRFSGSGFGTDFTLTISSLQPEDSASYYCQQSYNTPLTFGGGTKLEIKR

SEQ ID NO: 648 - protein, 108 aa, Artificial Sequence
  Description of Artificial Sequence: Synthetic polypeptide
DIQLTQSPSSLSASVGDRVTITCRASQRISSFLNWYQQKPGKVPKLLIYTASNLQNGVPSRFSGTGSGTDFTLTISSLQPEDFATYYCQQSYRTPLTFGGGTKVDIKR

SEQ ID NO: 649 - protein, 109 aa, Artificial Sequence
  Description of Artificial Sequence: Synthetic polypeptide
DIVMTQSPSSLSASVGDRVTITCRASQSISSYLNWYQQKPGKAPKLLIYAASSLQSGVPSRFSGSGSGTDFTLTISSLQPEDFATYYCQQSYSTPPLTFGGGTKVDIKR

SEQ ID NO: 650 - protein, 108 aa, Artificial Sequence
  Description of Artificial Sequence: Synthetic polypeptide
DIQMTQSPSSLSASVGDRVTITCRASQRISSYLNWYQQKPGKAPKVLISVASSLQSGVPSRFSGSGSGTDFTLTISSLQPEDFASYYCQQSYNTPLTFGGGTKVEIKR

SEQ ID NO: 651 - protein, 108 aa, Artificial Sequence
  Description of Artificial Sequence: Synthetic polypeptide
DIVMTQSPSSLSASVRDRVTITCRASQRISSYLNWFQQKPGKAPKVLIYTASSLQNGVPSRFSGSGSGTDFTLTISSLQPEDFATYYCQQSYRTPLTFGGGTKVEIKR

SEQ ID NO: 652 - protein, 107 aa, Artificial Sequence
  Description of Artificial Sequence: Synthetic polypeptide
DIQMTQSPSSLSASVGDRVTITCRASQRISSYLNWYQQKAGKAPKVLIYTASSLQSGVPSRFSGSGSGTDFTLTISSLQPEDFATYYCQQSYSTPLTFGGGTKVEIK

SEQ ID NO: 653 - protein, 108 aa, Artificial Sequence; identical to SEQ ID NO: 650
  Description of Artificial Sequence: Synthetic polypeptide

SEQ ID NO: 654 - protein, 108 aa, Artificial Sequence; identical to SEQ ID NO: 123
  Description of Artificial Sequence: Synthetic polypeptide

SEQ ID NO: 655 - protein, 108 aa, Artificial Sequence; identical to SEQ ID NO: 123
  Description of Artificial Sequence: Synthetic polypeptide

SEQ ID NO: 656 - protein, 108 aa, Artificial Sequence; identical to SEQ ID NO: 123
  Description of Artificial Sequence: Synthetic polypeptide

SEQ ID NO: 657 - protein, 108 aa, Artificial Sequence; identical to SEQ ID NO: 123
  Description of Artificial Sequence: Synthetic polypeptide

SEQ ID NO: 658 - protein, 108 aa, Artificial Sequence; identical to SEQ ID NO: 123
  Description of Artificial Sequence: Synthetic polypeptide

SEQ ID NO: 659 - protein, 108 aa, Artificial Sequence; identical to SEQ ID NO: 123
  Description of Artificial Sequence: Synthetic polypeptide

SEQ ID NO: 660 - protein, 108 aa, Artificial Sequence; identical to SEQ ID NO: 123
  Description of Artificial Sequence: Synthetic polypeptide

SEQ ID NO: 661 - protein, 108 aa, Artificial Sequence; identical to SEQ ID NO: 123
  Description of Artificial Sequence: Synthetic polypeptide

SEQ ID NO: 662 - protein, 108 aa, Artificial Sequence; identical to SEQ ID NO: 123
  Description of Artificial Sequence: Synthetic polypeptide

SEQ ID NO: 663 - protein, 108 aa, Artificial Sequence; identical to SEQ ID NO: 123
  Description of Artificial Sequence: Synthetic polypeptide

SEQ ID NO: 664 - protein, 108 aa, Artificial Sequence; identical to SEQ ID NO: 123
  Description of Artificial Sequence: Synthetic polypeptide

SEQ ID NO: 665 - protein, 108 aa, Artificial Sequence; identical to SEQ ID NO: 123
  Description of Artificial Sequence: Synthetic polypeptide

SEQ ID NO: 666 - protein, 108 aa, Artificial Sequence; identical to SEQ ID NO: 123
  Description of Artificial Sequence: Synthetic polypeptide

SEQ ID NO: 667 - protein, 108 aa, Artificial Sequence; identical to SEQ ID NO: 123
  Description of Artificial Sequence: Synthetic polypeptide

SEQ ID NO: 668 - protein, 108 aa, Artificial Sequence; identical to SEQ ID NO: 123
  Description of Artificial Sequence: Synthetic polypeptide

SEQ ID NO: 669 - protein, 108 aa, Artificial Sequence; identical to SEQ ID NO: 123
  Description of Artificial Sequence: Synthetic polypeptide

SEQ ID NO: 670 - protein, 108 aa, Artificial Sequence; identical to SEQ ID NO: 123
  Description of Artificial Sequence: Synthetic polypeptide

SEQ ID NO: 671 - protein, 108 aa, Artificial Sequence; identical to SEQ ID NO: 123
  Description of Artificial Sequence: Synthetic polypeptide

SEQ ID NO: 672 - protein, 108 aa, Artificial Sequence; identical to SEQ ID NO: 123
  Description of Artificial Sequence: Synthetic polypeptide

SEQ ID NO: 673 - protein, 108 aa, Artificial Sequence; identical to SEQ ID NO: 123
  Description of Artificial Sequence: Synthetic polypeptide

SEQ ID NO: 674 - protein, 108 aa, Artificial Sequence; identical to SEQ ID NO: 123
  Description of Artificial Sequence: Synthetic polypeptide

SEQ ID NO: 675 - protein, 108 aa, Artificial Sequence; identical to SEQ ID NO: 123
  Description of Artificial Sequence: Synthetic polypeptide

SEQ ID NO: 676 - protein, 108 aa, Artificial Sequence; identical to SEQ ID NO: 123
  Description of Artificial Sequence: Synthetic polypeptide

SEQ ID NO: 677 - protein, 108 aa, Artificial Sequence; identical to SEQ ID NO: 123
  Description of Artificial Sequence: Synthetic polypeptide

SEQ ID NO: 678 - protein, 6 aa, Artificial Sequence
  Description of Artificial Sequence: Synthetic peptide
HSVSRN

SEQ ID NO: 679 - protein, 6 aa, Artificial Sequence
  Description of Artificial Sequence: Synthetic peptide
QSVSSN

SEQ ID NO: 680 - protein, 6 aa, Artificial Sequence
  Description of Artificial Sequence: Synthetic peptide
QSISSY

SEQ ID NO: 681 - protein, 7 aa, Artificial Sequence
  Description of Artificial Sequence: Synthetic peptide
QSVSSSY

SEQ ID NO: 682 - protein, 6 aa, Artificial Sequence
  Description of Artificial Sequence: Synthetic peptide
QSISSY

SEQ ID NO: 683 - protein, 6 aa, Artificial Sequence
  Description of Artificial Sequence: Synthetic peptide
QSISNY

SEQ ID NO: 684 - protein, 6 aa, Artificial Sequence
  Description of Artificial Sequence: Synthetic peptide
QDINNY

SEQ ID NO: 685 - protein, 6 aa, Artificial Sequence
  Description of Artificial Sequence: Synthetic peptide
QSVSSN

SEQ ID NO: 686 - protein, 6 aa, Artificial Sequence
  Description of Artificial Sequence: Synthetic peptide
QSVSSN

SEQ ID NO: 687 - protein, 6 aa, Artificial Sequence
  Description of Artificial Sequence: Synthetic peptide
QSISRN

SEQ ID NO: 688 - protein, 6 aa, Artificial Sequence
  Description of Artificial Sequence: Synthetic peptide
QRISSN

SEQ ID NO: 689 - protein, 6 aa, Artificial Sequence
  Description of Artificial Sequence: Synthetic peptide
QSVSRN

SEQ ID NO: 690 - protein, 6 aa, Artificial Sequence
  Description of Artificial Sequence: Synthetic peptide
QSVSSN

SEQ ID NO: 691 - protein, 6 aa, Artificial Sequence
  Description of Artificial Sequence: Synthetic peptide
QSISRN

SEQ ID NO: 692 - protein, 6 aa, Artificial Sequence
  Description of Artificial Sequence: Synthetic peptide
QSISRN

SEQ ID NO: 693 - protein, 6 aa, Artificial Sequence
  Description of Artificial Sequence: Synthetic peptide
QSVSRN

SEQ ID NO: 694 - protein, 6 aa, Artificial Sequence
  Description of Artificial Sequence: Synthetic peptide
QSVSRN

SEQ ID NO: 695 - protein, 6 aa, Artificial Sequence
  Description of Artificial Sequence: Synthetic peptide
QRISSN

SEQ ID NO: 696 - protein, 6 aa, Artificial Sequence
  Description of Artificial Sequence: Synthetic peptide
QSISRN

SEQ ID NO: 697 - protein, 6 aa, Artificial Sequence
  Description of Artificial Sequence: Synthetic peptide
QSISRN

SEQ ID NO: 698 - protein, 6 aa, Artificial Sequence
  Description of Artificial Sequence: Synthetic peptide
QSVSSN

SEQ ID NO: 699 - protein, 6 aa, Artificial Sequence
  Description of Artificial Sequence: Synthetic peptide
QSVSGN

SEQ ID NO: 700 - protein, 12 aa, Artificial Sequence
  Description of Artificial Sequence: Synthetic peptide
QSVLYSSNNKNY

SEQ ID NO: 701 - protein, 6 aa, Artificial Sequence
  Description of Artificial Sequence: Synthetic peptide
QGISNY

SEQ ID NO: 702 - protein, 6 aa, Artificial Sequence
  Description of Artificial Sequence: Synthetic peptide
QSVSRN

SEQ ID NO: 703 - protein, 6 aa, Artificial Sequence
  Description of Artificial Sequence: Synthetic peptide
QSISRN

SEQ ID NO: 704 - protein, 6 aa, Artificial Sequence
  Description of Artificial Sequence: Synthetic peptide
QSISRN

SEQ ID NO: 705 - protein, 6 aa, Artificial Sequence
  Description of Artificial Sequence: Synthetic peptide
QNISSY

SEQ ID NO: 706 - protein, 6 aa, Artificial Sequence
  Description of Artificial Sequence: Synthetic peptide
QSISSY

SEQ ID NO: 707 - protein, 6 aa, Artificial Sequence
  Description of Artificial Sequence: Synthetic peptide
QSIRNY

SEQ ID NO: 708 - protein, 6 aa, Artificial Sequence
  Description of Artificial Sequence: Synthetic peptide
QSISRH

SEQ ID NO: 709 - protein, 6 aa, Artificial Sequence
  Description of Artificial Sequence: Synthetic peptide
QSISSY

SEQ ID NO: 710 - protein, 6 aa, Artificial Sequence
  Description of Artificial Sequence: Synthetic peptide
QSIRSY

SEQ ID NO: 711 - protein, 6 aa, Artificial Sequence
  Description of Artificial Sequence: Synthetic peptide
QSINNY

SEQ ID NO: 712 - protein, 6 aa, Artificial Sequence
  Description of Artificial Sequence: Synthetic peptide
QYIDDD

SEQ ID NO: 713 - protein, 6 aa, Artificial Sequence
  Description of Artificial Sequence: Synthetic peptide
QGISSW

SEQ ID NO: 714 - protein, 6 aa, Artificial Sequence
  Description of Artificial Sequence: Synthetic peptide
QSISSY

SEQ ID NO: 715 - protein, 6 aa, Artificial Sequence
  Description of Artificial Sequence: Synthetic peptide
QGIRND

SEQ ID NO: 716 - protein, 6 aa, Artificial Sequence
  Description of Artificial Sequence: Synthetic peptide
QGISRW

SEQ ID NO: 717 - protein, 6 aa, Artificial Sequence
  Description of Artificial Sequence: Synthetic peptide
QGIRND

SEQ ID NO: 718 - protein, 6 aa, Artificial Sequence
  Description of Artificial Sequence: Synthetic peptide
QGIRND

SEQ ID NO: 719 - protein, 6 aa, Artificial Sequence
  Description of Artificial Sequence: Synthetic peptide
QGIRND

SEQ ID NO: 720 - protein, 6 aa, Artificial Sequence
  Description of Artificial Sequence: Synthetic peptide
QGIRND

SEQ ID NO: 721 - protein, 6 aa, Artificial Sequence
  Description of Artificial Sequence: Synthetic peptide
QVIRND

SEQ ID NO: 722 - protein, 7 aa, Artificial Sequence
  Description of Artificial Sequence: Synthetic peptide
QSVSSIY

SEQ ID NO: 723 - protein, 7 aa, Artificial Sequence
  Description of Artificial Sequence: Synthetic peptide
QSIRNIY

SEQ ID NO: 724 - protein, 7 aa, Artificial Sequence
  Description of Artificial Sequence: Synthetic peptide
QSIRNIY

SEQ ID NO: 725 - protein, 7 aa, Artificial Sequence
  Description of Artificial Sequence: Synthetic peptide
QSIRSIY

SEQ ID NO: 726 - protein, 6 aa, Artificial Sequence
  Description of Artificial Sequence: Synthetic peptide
QNINSN

SEQ ID NO: 727 - protein, 7 aa, Artificial Sequence
  Description of Artificial Sequence: Synthetic peptide
QSIRSIY

SEQ ID NO: 728 - protein, 7 aa, Artificial Sequence
  Description of Artificial Sequence: Synthetic peptide
QSVSSIY

SEQ ID NO: 729 - protein, 6 aa, Artificial Sequence
  Description of Artificial Sequence: Synthetic peptide
QSISSW

SEQ ID NO: 730 - protein, 12 aa, Artificial Sequence
  Description of Artificial Sequence: Synthetic peptide
QSLLFNSINKNY

SEQ ID NO: 731 - protein, 6 aa, Artificial Sequence
  Description of Artificial Sequence: Synthetic peptide
QRISSF

SEQ ID NO: 732 - protein, 6 aa, Artificial Sequence
  Description of Artificial Sequence: Synthetic peptide
QSVSSN

SEQ ID NO: 733 - protein, 6 aa, Artificial Sequence
  Description of Artificial Sequence: Synthetic peptide
QRISSF

SEQ ID NO: 734 - protein, 6 aa, Artificial Sequence
  Description of Artificial Sequence: Synthetic peptide
QRISSF

SEQ ID NO: 735 - protein, 6 aa, Artificial Sequence
  Description of Artificial Sequence: Synthetic peptide
QRISSF

SEQ ID NO: 736 - protein, 6 aa, Artificial Sequence
  Description of Artificial Sequence: Synthetic peptide
QRISSY

SEQ ID NO: 737 - protein, 6 aa, Artificial Sequence
  Description of Artificial Sequence: Synthetic peptide
QRISSF

SEQ ID NO: 738 - protein, 6 aa, Artificial Sequence
  Description of Artificial Sequence: Synthetic peptide
QSISSY

SEQ ID NO: 739 - protein, 6 aa, Artificial Sequence
  Description of Artificial Sequence: Synthetic peptide
QRISSY

SEQ ID NO: 740 - protein, 6 aa, Artificial Sequence
  Description of Artificial Sequence: Synthetic peptide
QRISSY

SEQ ID NO: 741 - protein, 6 aa, Artificial Sequence
  Description of Artificial Sequence: Synthetic peptide
QRISSY

SEQ ID NO: 742 - protein, 6 aa, Artificial Sequence
  Description of Artificial Sequence: Synthetic peptide
QRISSY

SEQ ID NO: 743 - protein, 6 aa, Artificial Sequence
  Description of Artificial Sequence: Synthetic peptide
QSISSY

SEQ ID NO: 744 - protein, 6 aa, Artificial Sequence
  Description of Artificial Sequence: Synthetic peptide
QSISSY

SEQ ID NO: 745 - protein, 6 aa, Artificial Sequence
  Description of Artificial Sequence: Synthetic peptide
QSISSY

SEQ ID NO: 746 - protein, 6 aa, Artificial Sequence
  Description of Artificial Sequence: Synthetic peptide
QSISSY

SEQ ID NO: 747 - protein, 6 aa, Artificial Sequence
  Description of Artificial Sequence: Synthetic peptide
QSISSY

SEQ ID NO: 748 - protein, 6 aa, Artificial Sequence
  Description of Artificial Sequence: Synthetic peptide
QSISSY

SEQ ID NO: 749 - protein, 6 aa, Artificial Sequence
  Description of Artificial Sequence: Synthetic peptide
QSISSY

SEQ ID NO: 750 - protein, 6 aa, Artificial Sequence
  Description of Artificial Sequence: Synthetic peptide
QSISSY

SEQ ID NO: 751 - protein, 6 aa, Artificial Sequence
  Description of Artificial Sequence: Synthetic peptide
QSISSY

SEQ ID NO: 752 - protein, 6 aa, Artificial Sequence
  Description of Artificial Sequence: Synthetic peptide
QSISSY

SEQ ID NO: 753 - protein, 6 aa, Artificial Sequence
  Description of Artificial Sequence: Synthetic peptide
QSISSY

SEQ ID NO: 754 - protein, 6 aa, Artificial Sequence
  Description of Artificial Sequence: Synthetic peptide
QSISSY

SEQ ID NO: 755 - protein, 6 aa, Artificial Sequence
  Description of Artificial Sequence: Synthetic peptide
QSISSY

SEQ ID NO: 756 - protein, 6 aa, Artificial Sequence
  Description of Artificial Sequence: Synthetic peptide
QSISSY

SEQ ID NO: 757 - protein, 6 aa, Artificial Sequence
  Description of Artificial Sequence: Synthetic peptide
QSISSY

SEQ ID NO: 758 - protein, 6 aa, Artificial Sequence
  Description of Artificial Sequence: Synthetic peptide
QSISSY

SEQ ID NO: 759 - protein, 6 aa, Artificial Sequence
  Description of Artificial Sequence: Synthetic peptide
QSISSY

SEQ ID NO: 760 - protein, 6 aa, Artificial Sequence
  Description of Artificial Sequence: Synthetic peptide
QSISSY

SEQ ID NO: 761 - protein, 6 aa, Artificial Sequence
  Description of Artificial Sequence: Synthetic peptide
QSISSY

SEQ ID NO: 762 - protein, 6 aa, Artificial Sequence
  Description of Artificial Sequence: Synthetic peptide
QSISSY

SEQ ID NO: 763 - protein, 6 aa, Artificial Sequence
  Description of Artificial Sequence: Synthetic peptide
QSISSY

SEQ ID NO: 764 - protein, 6 aa, Artificial Sequence
  Description of Artificial Sequence: Synthetic peptide
QSISSY

SEQ ID NO: 765 - protein, 6 aa, Artificial Sequence
  Description of Artificial Sequence: Synthetic peptide
QSISSY

SEQ ID NO: 766 - protein, 6 aa, Artificial Sequence
  Description of Artificial Sequence: Synthetic peptide
QSISSY

SEQ ID NO: 767 - protein, 3 aa, Artificial Sequence
  Description of Artificial Sequence: Synthetic peptide
GAS

SEQ ID NO: 768 - protein, 3 aa, Artificial Sequence
  Description of Artificial Sequence: Synthetic peptide
GAS

SEQ ID NO: 769 - protein, 3 aa, Artificial Sequence
  Description of Artificial Sequence: Synthetic peptide
AAS

SEQ ID NO: 770 - protein, 3 aa, Artificial Sequence
  Description of Artificial Sequence: Synthetic peptide
GAS

SEQ ID NO: 771 - protein, 3 aa, Artificial Sequence
  Description of Artificial Sequence: Synthetic peptide
AAS

SEQ ID NO: 772 - protein, 3 aa, Artificial Sequence
  Description of Artificial Sequence: Synthetic peptide
AAS

SEQ ID NO: 773 - protein, 3 aa, Artificial Sequence
  Description of Artificial Sequence: Synthetic peptide
DAS

SEQ ID NO: 774 - protein, 3 aa, Artificial Sequence
  Description of Artificial Sequence: Synthetic peptide
GAS

SEQ ID NO: 775 - protein, 3 aa, Artificial Sequence
  Description of Artificial Sequence: Synthetic peptide
GAS

SEQ ID NO: 776 - protein, 3 aa, Artificial Sequence
  Description of Artificial Sequence: Synthetic peptide
GAS

SEQ ID NO: 777 - protein, 3 aa, Artificial Sequence
  Description of Artificial Sequence: Synthetic peptide
GAS

SEQ ID NO: 778 - protein, 3 aa, Artificial Sequence
  Description of Artificial Sequence: Synthetic peptide
GAS

SEQ ID NO: 779 - protein, 3 aa, Artificial Sequence
  Description of Artificial Sequence: Synthetic peptide
GAS

SEQ ID NO: 780 - protein, 3 aa, Artificial Sequence
  Description of Artificial Sequence: Synthetic peptide
GAS

SEQ ID NO: 781 - protein, 3 aa, Artificial Sequence
  Description of Artificial Sequence: Synthetic peptide
GAS

SEQ ID NO: 782 - protein, 3 aa, Artificial Sequence
  Description of Artificial Sequence: Synthetic peptide
GAS

SEQ ID NO: 783 - protein, 3 aa, Artificial Sequence
  Description of Artificial Sequence: Synthetic peptide
GAS

SEQ ID NO: 784 - protein, 3 aa, Artificial Sequence
  Description of Artificial Sequence: Synthetic peptide
GAS

SEQ ID NO: 785 - protein, 3 aa, Artificial Sequence
  Description of Artificial Sequence: Synthetic peptide
GAT

SEQ ID NO: 786 - protein, 3 aa, Artificial Sequence
  Description of Artificial Sequence: Synthetic peptide
GAT

SEQ ID NO: 787 - protein, 3 aa, Artificial Sequence
  Description of Artificial Sequence: Synthetic peptide
GAS

SEQ ID NO: 788 - protein, 3 aa, Artificial Sequence
  Description of Artificial Sequence: Synthetic peptide
GAS

SEQ ID NO: 789 - protein, 3 aa, Artificial Sequence
  Description of Artificial Sequence: Synthetic peptide
WAS

SEQ ID NO: 790 - protein, 3 aa, Artificial Sequence
  Description of Artificial Sequence: Synthetic peptide
AAS

SEQ ID NO: 791 - protein, 3 aa, Artificial Sequence
  Description of Artificial Sequence: Synthetic peptide
GAS

SEQ ID NO: 792 - protein, 3 aa, Artificial Sequence
  Description of Artificial Sequence: Synthetic peptide
GAT

SEQ ID NO: 793 - protein, 3 aa, Artificial Sequence
  Description of Artificial Sequence: Synthetic peptide
GAT

SEQ ID NO: 794 - protein, 3 aa, Artificial Sequence
  Description of Artificial Sequence: Synthetic peptide
AAS

SEQ ID NO: 795 - protein, 3 aa, Artificial Sequence
  Description of Artificial Sequence: Synthetic peptide
AAS

SEQ ID NO: 796 - protein, 3 aa, Artificial Sequence
  Description of Artificial Sequence: Synthetic peptide
AAS

SEQ ID NO: 797 - protein, 3 aa, Artificial Sequence
  Description of Artificial Sequence: Synthetic peptide
AAS

SEQ ID NO: 798 - protein, 3 aa, Artificial Sequence
  Description of Artificial Sequence: Synthetic peptide
AAS

SEQ ID NO: 799 - protein, 3 aa, Artificial Sequence
  Description of Artificial Sequence: Synthetic peptide
AAS

SEQ ID NO: 800 - protein, 3 aa, Artificial Sequence
  Description of Artificial Sequence: Synthetic peptide
AAS

SEQ ID NO: 801 - protein, 3 aa, Artificial Sequence
  Description of Artificial Sequence: Synthetic peptide
EAS

SEQ ID NO: 802 - protein, 3 aa, Artificial Sequence
  Description of Artificial Sequence: Synthetic peptide
AVS

SEQ ID NO: 803 - protein, 3 aa, Artificial Sequence
  Description of Artificial Sequence: Synthetic peptide
DAS

SEQ ID NO: 804 - protein, 3 aa, Artificial Sequence
  Description of Artificial Sequence: Synthetic peptide
AAS

SEQ ID NO: 805 - protein, 3 aa, Artificial Sequence
  Description of Artificial Sequence: Synthetic peptide
AAS

SEQ ID NO: 806 - protein, 3 aa, Artificial Sequence
  Description of Artificial Sequence: Synthetic peptide
AAS

SEQ ID NO: 807 - protein, 3 aa, Artificial Sequence
  Description of Artificial Sequence: Synthetic peptide
AAS

SEQ ID NO: 808 - protein, 3 aa, Artificial Sequence
  Description of Artificial Sequence: Synthetic peptide
AAS

SEQ ID NO: 809 - protein, 3 aa, Artificial Sequence
  Description of Artificial Sequence: Synthetic peptide
AAS

SEQ ID NO: 810 - protein, 3 aa, Artificial Sequence
  Description of Artificial Sequence: Synthetic peptide
AAS

SEQ ID NO: 811 - protein, 3 aa, Artificial Sequence
  Description of Artificial Sequence: Synthetic peptide
GAS

SEQ ID NO: 812 - protein, 3 aa, Artificial Sequence
  Description of Artificial Sequence: Synthetic peptide
GAS

SEQ ID NO: 813 - protein, 3 aa, Artificial Sequence
  Description of Artificial Sequence: Synthetic peptide
GAS

SEQ ID NO: 814 - protein, 3 aa, Artificial Sequence
  Description of Artificial Sequence: Synthetic peptide
GAS

SEQ ID NO: 815 - protein, 3 aa, Artificial Sequence
  Description of Artificial Sequence: Synthetic peptide
GAS

SEQ ID NO: 816 - protein, 3 aa, Artificial Sequence
  Description of Artificial Sequence: Synthetic peptide
GAS

SEQ ID NO: 817 - protein, 3 aa, Artificial Sequence
  Description of Artificial Sequence: Synthetic peptide
GAS

SEQ ID NO: 818 - protein, 3 aa, Artificial Sequence
  Description of Artificial Sequence: Synthetic peptide
KAS

SEQ ID NO: 819 - protein, 3 aa, Artificial Sequence
  Description of Artificial Sequence: Synthetic peptide
WAS

SEQ ID NO: 820 - protein, 3 aa, Artificial Sequence
  Description of Artificial Sequence: Synthetic peptide
TAS

SEQ ID NO: 821 - protein, 3 aa, Artificial Sequence
  Description of Artificial Sequence: Synthetic peptide
GAS

SEQ ID NO: 822 - protein, 3 aa, Artificial Sequence
  Description of Artificial Sequence: Synthetic peptide
TAS

SEQ ID NO: 823 - protein, 3 aa, Artificial Sequence
  Description of Artificial Sequence: Synthetic peptide
TAS

SEQ ID NO: 824 - protein, 3 aa, Artificial Sequence
  Description of Artificial Sequence: Synthetic peptide
TAS

SEQ ID NO: 825 - protein, 3 aa, Artificial Sequence
  Description of Artificial Sequence: Synthetic peptide
VAS

SEQ ID NO: 826 - protein, 3 aa, Artificial Sequence
  Description of Artificial Sequence: Synthetic peptide
TAS

SEQ ID NO: 827 - protein, 3 aa, Artificial Sequence
  Description of Artificial Sequence: Synthetic peptide
AAS

SEQ ID NO: 828 - protein, 3 aa, Artificial Sequence
  Description of Artificial Sequence: Synthetic peptide
VAS

SEQ ID NO: 829 - protein, 3 aa, Artificial Sequence
  Description of Artificial Sequence: Synthetic peptide
TAS

SEQ ID NO: 830 - protein, 3 aa, Artificial Sequence
  Description of Artificial Sequence: Synthetic peptide
TAS

SEQ ID NO: 831 - protein, 3 aa, Artificial Sequence
  Description of Artificial Sequence: Synthetic peptide
VAS

SEQ ID NO: 832 - protein, 3 aa, Artificial Sequence
  Description of Artificial Sequence: Synthetic peptide
AAS

SEQ ID NO: 833 - protein, 3 aa, Artificial Sequence
  Description of Artificial Sequence: Synthetic peptide
AAS

SEQ ID NO: 834 - protein, 3 aa, Artificial Sequence
  Description of Artificial Sequence: Synthetic peptide
AAS

SEQ ID NO: 835 - protein, 3 aa, Artificial Sequence
  Description of Artificial Sequence: Synthetic peptide
AAS

SEQ ID NO: 836 - protein, 3 aa, Artificial Sequence
  Description of Artificial Sequence: Synthetic peptide
AAS

SEQ ID NO: 837 - protein, 3 aa, Artificial Sequence
  Description of Artificial Sequence: Synthetic peptide
AAS

SEQ ID NO: 838 - protein, 3 aa, Artificial Sequence
  Description of Artificial Sequence: Synthetic peptide
AAS

SEQ ID NO: 839 - protein, 3 aa, Artificial Sequence
  Description of Artificial Sequence: Synthetic peptide
AAS

SEQ ID NO: 840 - protein, 3 aa, Artificial Sequence
  Description of Artificial Sequence: Synthetic peptide
AAS

SEQ ID NO: 841 - protein, 3 aa, Artificial Sequence
  Description of Artificial Sequence: Synthetic peptide
AAS

SEQ ID NO: 842 - protein, 3 aa, Artificial Sequence
  Description of Artificial Sequence: Synthetic peptide
AAS

SEQ ID NO: 843 - protein, 3 aa, Artificial Sequence
  Description of Artificial Sequence: Synthetic peptide
AAS

SEQ ID NO: 844 - protein, 3 aa, Artificial Sequence
  Description of Artificial Sequence: Synthetic peptide
AAS

SEQ ID NO: 845 - protein, 3 aa, Artificial Sequence
  Description of Artificial Sequence: Synthetic peptide
AAS

SEQ ID NO: 846 - protein, 3 aa, Artificial Sequence
  Description of Artificial Sequence: Synthetic peptide
AAS

SEQ ID NO: 847 - protein, 3 aa, Artificial Sequence
  Description of Artificial Sequence: Synthetic peptide
AAS

SEQ ID NO: 848 - protein, 3 aa, Artificial Sequence
  Description of Artificial Sequence: Synthetic peptide
AAS

SEQ ID NO: 849 - protein, 3 aa, Artificial Sequence
  Description of Artificial Sequence: Synthetic peptide
AAS

SEQ ID NO: 850 - protein, 3 aa, Artificial Sequence
  Description of Artificial Sequence: Synthetic peptide
AAS

SEQ ID NO: 851 - protein, 3 aa, Artificial Sequence
  Description of Artificial Sequence: Synthetic peptide
AAS

SEQ ID NO: 852 - protein, 3 aa, Artificial Sequence
  Description of Artificial Sequence: Synthetic peptide
AAS

SEQ ID NO: 853 - protein, 3 aa, Artificial Sequence
  Description of Artificial Sequence: Synthetic peptide
AAS

SEQ ID NO: 854 - protein, 3 aa, Artificial Sequence
  Description of Artificial Sequence: Synthetic peptide
AAS

SEQ ID NO: 855 - protein, 3 aa, Artificial Sequence
  Description of Artificial Sequence: Synthetic peptide
AAS

SEQ ID NO: 856 - protein, 9 aa, Artificial Sequence
  Description of Artificial Sequence: Synthetic peptide
QQYNNWPLT

SEQ ID NO: 857 - protein, 9 aa, Artificial Sequence
  Description of Artificial Sequence: Synthetic peptide
QQYYNWPLT

SEQ ID NO: 858 - protein, 10 aa, Artificial Sequence
  Description of Artificial Sequence: Synthetic peptide
QQSYSTPPIT

SEQ ID NO: 859 - protein, 9 aa, Artificial Sequence
  Description of Artificial Sequence: Synthetic peptide
QQYGSSPWT

SEQ ID NO: 860 - protein, 10 aa, Artificial Sequence
  Description of Artificial Sequence: Synthetic peptide
QQSYSTPPIT

SEQ ID NO: 861 - protein, 10 aa, Artificial Sequence
  Description of Artificial Sequence: Synthetic peptide
QQSYSNPPIT

SEQ ID NO: 862 - protein, 9 aa, Artificial Sequence
  Description of Artificial Sequence: Synthetic peptide
QQYDDLPFT

SEQ ID NO: 863 - protein, 9 aa, Artificial Sequence
  Description of Artificial Sequence: Synthetic peptide
QHYINWPLT

SEQ ID NO: 864 - protein, 9 aa, Artificial Sequence
  Description of Artificial Sequence: Synthetic peptide
QHYINWPLT

SEQ ID NO: 865 - protein, 9 aa, Artificial Sequence
  Description of Artificial Sequence: Synthetic peptide
QQYNNRPLT

SEQ ID NO: 866 - protein, 9 aa, Artificial Sequence
  Description of Artificial Sequence: Synthetic peptide
QQHHNWPLT

SEQ ID NO: 867 - protein, 9 aa, Artificial Sequence
  Description of Artificial Sequence: Synthetic peptide
QQYNNWPLT

SEQ ID NO: 868 - protein, 9 aa, Artificial Sequence
  Description of Artificial Sequence: Synthetic peptide
QQYNNRPLT

SEQ ID NO: 869 - protein, 9 aa, Artificial Sequence
  Description of Artificial Sequence: Synthetic peptide
QQYNNRPLT

SEQ ID NO: 870 - protein, 9 aa, Artificial Sequence
  Description of Artificial Sequence: Synthetic peptide
QQYNNRPLT

SEQ ID NO: 871 - protein, 9 aa, Artificial Sequence
  Description of Artificial Sequence: Synthetic peptide
QQYNNRPLT

SEQ ID NO: 872 - protein, 9 aa, Artificial Sequence
  Description of Artificial Sequence: Synthetic peptide
QQYNNRPLT

SEQ ID NO: 873 - protein, 9 aa, Artificial Sequence
  Description of Artificial Sequence: Synthetic peptide
QQHNNWPLT

SEQ ID NO: 874 - protein, 9 aa, Artificial Sequence
  Description of Artificial Sequence: Synthetic peptide
QQYNNRPLT

SEQ ID NO: 875 - protein, 9 aa, Artificial Sequence
  Description of Artificial Sequence: Synthetic peptide
QQYNNRPLT

SEQ ID NO: 876 - protein, 9 aa, Artificial Sequence
  Description of Artificial Sequence: Synthetic peptide
QQYNNRPLT

SEQ ID NO: 877 - protein, 9 aa, Artificial Sequence
  Description of Artificial Sequence: Synthetic peptide
QHYYNWPLT

SEQ ID NO: 878 - protein, 9 aa, Artificial Sequence
  Description of Artificial Sequence: Synthetic peptide
QQYYSTPYT

SEQ ID NO: 879 - protein, 9 aa, Artificial Sequence
  Description of Artificial Sequence: Synthetic peptide
QQYNSYPLT

SEQ ID NO: 880 - protein, 9 aa, Artificial Sequence
  Description of Artificial Sequence: Synthetic peptide
QQYSNWPLT

SEQ ID NO: 881 - protein, 9 aa, Artificial Sequence
  Description of Artificial Sequence: Synthetic peptide
QQYNNRPLT

SEQ ID NO: 882 - protein, 9 aa, Artificial Sequence
  Description of Artificial Sequence: Synthetic peptide
QQYNNRPLT

SEQ ID NO: 883 - protein, 10 aa, Artificial Sequence
  Description of Artificial Sequence: Synthetic peptide
QQTYSTPPIT

SEQ ID NO: 884 - protein, 10 aa, Artificial Sequence
  Description of Artificial Sequence: Synthetic peptide
QQSYSTPPIT

SEQ ID NO: 885 - protein, 10 aa, Artificial Sequence
  Description of Artificial Sequence: Synthetic peptide
QQSYSNPPIT

SEQ ID NO: 886 - protein, 10 aa, Artificial Sequence
  Description of Artificial Sequence: Synthetic peptide
QQSYSNPPIT

SEQ ID NO: 887 - protein, 10 aa, Artificial Sequence
  Description of Artificial Sequence: Synthetic peptide
QQSYSTPPIT

SEQ ID NO: 888 - protein, 10 aa, Artificial Sequence
  Description of Artificial Sequence: Synthetic peptide
QQTYSNPPIT

SEQ ID NO: 889 - protein, 9 aa, Artificial Sequence
  Description of Artificial Sequence: Synthetic peptide
QQSYSFPWT

SEQ ID NO: 890 - protein, 9 aa, Artificial Sequence
  Description of Artificial Sequence: Synthetic peptide
LQHDNFPYT

SEQ ID NO: 891 - protein, 9 aa, Artificial Sequence
  Description of Artificial Sequence: Synthetic peptide
QQANSFPFT

SEQ ID NO: 892 - protein, 9 aa, Artificial Sequence
  Description of Artificial Sequence: Synthetic peptide
QQYDNLPFT

SEQ ID NO: 893 - protein, 9 aa, Artificial Sequence
  Description of Artificial Sequence: Synthetic peptide
LQHNSYPYT

SEQ ID NO: 894 - protein, 9 aa, Artificial Sequence
  Description of Artificial Sequence: Synthetic peptide
QKANSFPFT

SEQ ID NO: 895 - protein, 9 aa, Artificial Sequence
  Description of Artificial Sequence: Synthetic peptide
LQHNSYPYT

SEQ ID NO: 896 - protein, 9 aa, Artificial Sequence
  Description of Artificial Sequence: Synthetic peptide
LQHNSYPYT

SEQ ID NO: 897 - protein, 9 aa, Artificial Sequence
  Description of Artificial Sequence: Synthetic peptide
LQHNSYPYT

SEQ ID NO: 898 - protein, 9 aa, Artificial Sequence
  Description of Artificial Sequence: Synthetic peptide
LQHNSYPYT

SEQ ID NO: 899 - protein, 9 aa, Artificial Sequence
  Description of Artificial Sequence: Synthetic peptide
LQHNSYPYT

SEQ ID NO: 900 - protein, 9 aa, Artificial Sequence
  Description of Artificial Sequence: Synthetic peptide
QQRAHSPYT

SEQ ID NO: 901 - protein, 9 aa, Artificial Sequence
  Description of Artificial Sequence: Synthetic peptide
QQRVSLPYT

SEQ ID NO: 902 - protein, 9 aa, Artificial Sequence
  Description of Artificial Sequence: Synthetic peptide
QQRVSSPYT

SEQ ID NO: 903 - protein, 9 aa, Artificial Sequence
  Description of Artificial Sequence: Synthetic peptide
QQRVSSPYT

SEQ ID NO: 904 - protein, 9 aa, Artificial Sequence
  Description of Artificial Sequence: Synthetic peptide
QQYYNWPIT

SEQ ID NO: 905 - protein, 9 aa, Artificial Sequence
  Description of Artificial Sequence: Synthetic peptide
QQRVSSPYT

SEQ ID NO: 906 - protein, 9 aa, Artificial Sequence
  Description of Artificial Sequence: Synthetic peptide
HQRVSSPYT

SEQ ID NO: 907 - protein, 8 aa, Artificial Sequence
  Description of Artificial Sequence: Synthetic peptide
QQYNSYSP

SEQ ID NO: 908 - protein, 9 aa, Artificial Sequence
  Description of Artificial Sequence: Synthetic peptide
QQYYSIPWT

SEQ ID NO: 909 - protein, 9 aa, Artificial Sequence
  Description of Artificial Sequence: Synthetic peptide
QQSYRTPLT

SEQ ID NO: 910 - protein, 9 aa, Artificial Sequence
  Description of Artificial Sequence: Synthetic peptide
QQYNNWPLT

SEQ ID NO: 911 - protein, 9 aa, Artificial Sequence
  Description of Artificial Sequence: Synthetic peptide
QQSYRTPLT

SEQ ID NO: 912 - protein, 9 aa, Artificial Sequence
  Description of Artificial Sequence: Synthetic peptide
QQSYRTPLT

SEQ ID NO: 913 - protein, 9 aa, Artificial Sequence
  Description of Artificial Sequence: Synthetic peptide
QQSYRTPLT

SEQ ID NO: 914 - protein, 9 aa, Artificial Sequence
  Description of Artificial Sequence: Synthetic peptide
QQSYNTPLT

SEQ ID NO: 915 - protein, 9 aa, Artificial Sequence
  Description of Artificial Sequence: Synthetic peptide
QQSYRTPLT

SEQ ID NO: 916 - protein, 10 aa, Artificial Sequence
  Description of Artificial Sequence: Synthetic peptide
QQSYSTPPLT

SEQ ID NO: 917 - protein, 9 aa, Artificial Sequence
  Description of Artificial Sequence: Synthetic peptide
QQSYNTPLT

SEQ ID NO: 918 - protein, 9 aa, Artificial Sequence
  Description of Artificial Sequence: Synthetic peptide
QQSYRTPLT

SEQ ID NO: 919 - protein, 9 aa, Artificial Sequence
  Description of Artificial Sequence: Synthetic peptide
QQSYSTPLT

SEQ ID NO: 920 - protein, 9 aa, Artificial Sequence
  Description of Artificial Sequence: Synthetic peptide
QQSYNTPLT

SEQ ID NO: 921 - protein, 10 aa, Artificial Sequence
  Description of Artificial Sequence: Synthetic peptide
QQSYSTPPIT

SEQ ID NO: 922 - protein, 10 aa, Artificial Sequence
  Description of Artificial Sequence: Synthetic peptide
QQSYSTPPIT

SEQ ID NO: 923 - protein, 10 aa, Artificial Sequence
  Description of Artificial Sequence: Synthetic peptide
QQSYSTPPIT

SEQ ID NO: 924 - protein, 10 aa, Artificial Sequence
  Description of Artificial Sequence: Synthetic peptide
QQSYSTPPIT

SEQ ID NO: 925 - protein, 10 aa, Artificial Sequence
  Description of Artificial Sequence: Synthetic peptide
QQSYSTPPIT

SEQ ID NO: 926 - protein, 10 aa, Artificial Sequence
  Description of Artificial Sequence: Synthetic peptide
QQSYSTPPIT

SEQ ID NO: 927 - protein, 10 aa, Artificial Sequence
  Description of Artificial Sequence: Synthetic peptide
QQSYSTPPIT

SEQ ID NO: 928 - protein, 10 aa, Artificial Sequence
  Description of Artificial Sequence: Synthetic peptide
QQSYSTPPIT

SEQ ID NO: 929 - protein, 10 aa, Artificial Sequence
  Description of Artificial Sequence: Synthetic peptide
QQSYSTPPIT

SEQ ID NO: 930 - protein, 10 aa, Artificial Sequence
  Description of Artificial Sequence: Synthetic peptide
QQSYSTPPIT

SEQ ID NO: 931 - protein, 10 aa, Artificial Sequence
  Description of Artificial Sequence: Synthetic peptide
QQSYSTPPIT

SEQ ID NO: 932 - protein, 10 aa, Artificial Sequence
  Description of Artificial Sequence: Synthetic peptide
QQSYSTPPIT

SEQ ID NO: 933 - protein, 10 aa, Artificial Sequence
  Description of Artificial Sequence: Synthetic peptide
QQSYSTPPIT

SEQ ID NO: 934 - protein, 10 aa, Artificial Sequence
  Description of Artificial Sequence: Synthetic peptide
QQSYSTPPIT

SEQ ID NO: 935 - protein, 10 aa, Artificial Sequence
  Description of Artificial Sequence: Synthetic peptide
QQSYSTPPIT

SEQ ID NO: 936 - protein, 10 aa, Artificial Sequence
  Description of Artificial Sequence: Synthetic peptide
QQSYSTPPIT

SEQ ID NO: 937 - protein, 10 aa, Artificial Sequence
  Description of Artificial Sequence: Synthetic peptide
QQSYSTPPIT

SEQ ID NO: 938 - protein, 10 aa, Artificial Sequence
  Description of Artificial Sequence: Synthetic peptide
QQSYSTPPIT

SEQ ID NO: 939 - protein, 10 aa, Artificial Sequence
  Description of Artificial Sequence: Synthetic peptide
QQSYSTPPIT

SEQ ID NO: 940 - protein, 10 aa, Artificial Sequence
  Description of Artificial Sequence: Synthetic peptide
QQSYSTPPIT

SEQ ID NO: 941 - protein, 10 aa, Artificial Sequence
  Description of Artificial Sequence: Synthetic peptide
QQSYSTPPIT

SEQ ID NO: 942 - protein, 10 aa, Artificial Sequence
  Description of Artificial Sequence: Synthetic peptide
QQSYSTPPIT

SEQ ID NO: 943 - protein, 10 aa, Artificial Sequence
  Description of Artificial Sequence: Synthetic peptide
QQSYSTPPIT

SEQ ID NO: 944 - protein, 10 aa, Artificial Sequence
  Description of Artificial Sequence: Synthetic peptide
QQSYSTPPIT

SEQ ID NO: 945 - protein, 123 aa, Artificial Sequence; identical to SEQ ID NO: 240
  Description of Artificial Sequence: Synthetic polypeptide

SEQ ID NO: 946 - protein, 123 aa, Artificial Sequence; identical to SEQ ID NO: 233
  Description of Artificial Sequence: Synthetic polypeptide

SEQ ID NO: 947 - protein, 123 aa, Artificial Sequence; identical to SEQ ID NO: 240
  Description of Artificial Sequence: Synthetic polypeptide

SEQ ID NO: 948 - protein, 118 aa, Artificial Sequence; identical to SEQ ID NO: 244
  Description of Artificial Sequence: Synthetic polypeptide

SEQ ID NO: 949 - protein, 118 aa, Artificial Sequence; identical to SEQ ID NO: 243
  Description of Artificial Sequence: Synthetic polypeptide

SEQ ID NO: 950 - protein, 119 aa, Artificial Sequence
  Description of Artificial Sequence: Synthetic polypeptide
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 951 - protein, 8 aa, Artificial Sequence
  Description of Artificial Sequence: Synthetic peptide
GFTFDDYT

SEQ ID NO: 952 - protein, 8 aa, Artificial Sequence
  Description of Artificial Sequence: Synthetic peptide
GFTFDDFT

SEQ ID NO: 953 - protein, 8 aa, Artificial Sequence
  Description of Artificial Sequence: Synthetic peptide
GFTFDDYT

SEQ ID NO: 954 - protein, 8 aa, Artificial Sequence
  Description of Artificial Sequence: Synthetic peptide
GFTFRSYA

SEQ ID NO: 955 - protein, 8 aa, Artificial Sequence
  Description of Artificial Sequence: Synthetic peptide
GFTFRSYG

SEQ ID NO: 956 - protein, 8 aa, Artificial Sequence
  Description of Artificial Sequence: Synthetic peptide
GYTFTRYT

SEQ ID NO: 957 - protein, 8 aa, Artificial Sequence
  Description of Artificial Sequence: Synthetic peptide
ISWNSGSI

SEQ ID NO: 958 - protein, 8 aa, Artificial Sequence
  Description of Artificial Sequence: Synthetic peptide
ISWNSGSI

SEQ ID NO: 959 - protein, 8 aa, Artificial Sequence
  Description of Artificial Sequence: Synthetic peptide
ISWNSGSI

SEQ ID NO: 960 - protein, 8 aa, Artificial Sequence
  Description of Artificial Sequence: Synthetic peptide
VYYDGNNQ

SEQ ID NO: 961 - protein, 8 aa, Artificial Sequence
  Description of Artificial Sequence: Synthetic peptide
IYYDGKNK

SEQ ID NO: 962 - protein, 8 aa, Artificial Sequence
  Description of Artificial Sequence: Synthetic peptide
INPSRGYT

SEQ ID NO: 963 - protein, 16 aa, Artificial Sequence
  Description of Artificial Sequence: Synthetic peptide
AKDNSGYGHYYYGMDV

SEQ ID NO: 964 - protein, 16 aa, Artificial Sequence
  Description of Artificial Sequence: Synthetic peptide
AKDNSGYGYYYYGMDV

SEQ ID NO: 965 - protein, 16 aa, Artificial Sequence
  Description of Artificial Sequence: Synthetic peptide
AKDNSGYGHYYYGMDV

SEQ ID NO: 966 - protein, 11 aa, Artificial Sequence
  Description of Artificial Sequence: Synthetic peptide
ARGPGYNWLDP

SEQ ID NO: 967 - protein, 11 aa, Artificial Sequence
  Description of Artificial Sequence: Synthetic peptide
ARGPGYNWLDP

SEQ ID NO: 968 - protein, 12 aa, Artificial Sequence
  Description of Artificial Sequence: Synthetic peptide
ARYYDDHYCLDY

SEQ ID NO: 969 - protein, 108 aa, Artificial Sequence
  Description of Artificial Sequence: Synthetic polypeptide
AEIVMTQSPATLSVSPGERATLSCRASQSVSSNLAWYQQKPGQAPRLLIYGASTRATGIPARFSGSGSGTEFTLTISSLQSEDFAVYYCQHYINWPLTFGGGTKVEIK

SEQ ID NO: 970 - protein, 107 aa, Artificial Sequence; identical to SEQ ID NO: 589
  Description of Artificial Sequence: Synthetic polypeptide

SEQ ID NO: 971 - protein, 107 aa, Artificial Sequence; identical to SEQ ID NO: 596
  Description of Artificial Sequence: Synthetic polypeptide

SEQ ID NO: 972 - protein, 107 aa, Artificial Sequence; identical to SEQ ID NO: 600
  Description of Artificial Sequence: Synthetic polypeptide

SEQ ID NO: 973 - protein, 107 aa, Artificial Sequence; identical to SEQ ID NO: 599
  Description of Artificial Sequence: Synthetic polypeptide

SEQ ID NO: 974 - protein, 106 aa, Artificial Sequence
  Description of Artificial Sequence: Synthetic polypeptide
DIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 975 - protein, 6 aa, Artificial Sequence
  Description of Artificial Sequence: Synthetic peptide
QSVSSN

SEQ ID NO: 976 - protein, 6 aa, Artificial Sequence
  Description of Artificial Sequence: Synthetic peptide
HSVSRN

SEQ ID NO: 977 - protein, 6 aa, Artificial Sequence
  Description of Artificial Sequence: Synthetic peptide
QSVSSN

SEQ ID NO: 978 - protein, 6 aa, Artificial Sequence
  Description of Artificial Sequence: Synthetic peptide
QSVSRN

SEQ ID NO: 979 - protein, 6 aa, Artificial Sequence
  Description of Artificial Sequence: Synthetic peptide
QRISSN

SEQ ID NO: 980 - protein, 11 aa, Artificial Sequence
  Description of Artificial Sequence: Synthetic peptide
LSCRASQSVSY

SEQ ID NO: 981 - protein, 3 aa, Artificial Sequence
  Description of Artificial Sequence: Synthetic peptide
GAS

SEQ ID NO: 982 - protein, 3 aa, Artificial Sequence
  Description of Artificial Sequence: Synthetic peptide
GAS

SEQ ID NO: 983 - protein, 3 aa, Artificial Sequence
  Description of Artificial Sequence: Synthetic peptide
GAS

SEQ ID NO: 984 - protein, 3 aa, Artificial Sequence
  Description of Artificial Sequence: Synthetic peptide
GAS

SEQ ID NO: 985 - protein, 3 aa, Artificial Sequence
  Description of Artificial Sequence: Synthetic peptide
GAS

SEQ ID NO: 986 - protein, 3 aa, Artificial Sequence
  Description of Artificial Sequence: Synthetic peptide
DTS

SEQ ID NO: 987 - protein, 9 aa, Artificial Sequence
  Description of Artificial Sequence: Synthetic peptide
QHYINWPLT

SEQ ID NO: 988 - protein, 9 aa, Artificial Sequence
  Description of Artificial Sequence: Synthetic peptide
QQYNNWPLT

SEQ ID NO: 989 - protein, 9 aa, Artificial Sequence
  Description of Artificial Sequence: Synthetic peptide
QHYINWPLT

SEQ ID NO: 990 - protein, 9 aa, Artificial Sequence
  Description of Artificial Sequence: Synthetic peptide
QQYNNWPLT

SEQ ID NO: 991 - protein, 9 aa, Artificial Sequence
  Description of Artificial Sequence: Synthetic peptide
QQHHNWPLT

SEQ ID NO: 992 - protein, 9 aa, Artificial Sequence
  Description of Artificial Sequence: Synthetic peptide
QQWSSNPLT

SEQ ID NO: 993 - protein, 124 aa, Artificial Sequence; identical to SEQ ID NO: 319
  Description of Artificial Sequence: Synthetic polypeptide

SEQ ID NO: 994 - protein, 124 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDGSGYGYFYYYGMDVWGQGTTVTVSS

SEQ ID NO: 995 - protein, 124 aa, Artificial Sequence; identical to SEQ ID NO: 320
  Description of Artificial Sequence: Synthetic polypeptide

SEQ ID NO: 996 - protein, 124 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDGSGYGKFYYYGMDVWGQGTTVTVSS

SEQ ID NO: 997 - protein, 124 aa, Artificial Sequence; identical to SEQ ID NO: 321
  Description of Artificial Sequence: Synthetic polypeptide

SEQ ID NO: 998 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKYGSGYGKFYHYGLDVWGQGTTVTVSS

SEQ ID NO: 999 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKDGSGYGKFYHYGLDVWGQGTTVTVSS

SEQ ID NO: 1000 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKYGSGYGKFYYYGLDVWGQGTTVTVSS

SEQ ID NO: 1001 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKYGSGYGKFYHYGMDVWGQGTTVTVSS

SEQ ID NO: 1002 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKDGSGYGKFYHYGLDVWGQGTTVTVSS

SEQ ID NO: 1003 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKYGSGYGKFYYYGLDVWGQGTTVTVSS

SEQ ID NO: 1004 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKYGSGYGKFYHYGMDVWGQGTTVTVSS

SEQ ID NO: 1005 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKDGSGYGKFYYYGLDVWGQGTTVTVSS

SEQ ID NO: 1006 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKDGSGYGKFYHYGMDVWGQGTTVTVSS

SEQ ID NO: 1007 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKYGSGYGKFYYYGMDVWGQGTTVTVSS

SEQ ID NO: 1008 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKDGSGYGKFYYYGLDVWGQGTTVTVSS

SEQ ID NO: 1009 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKDGSGYGKFYHYGMDVWGQGTTVTVSS

SEQ ID NO: 1010 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKYGSGYGKFYYYGMDVWGQGTTVTVSS

SEQ ID NO: 1011 - protein, 124 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKDGSGYGKFYYYGMDVWGQGTTVTVSS

SEQ ID NO: 1012 - protein, 124 aa, Artificial Sequence; identical to SEQ ID NO: 306
  Description of Artificial Sequence: Synthetic polypeptide

SEQ ID NO: 1013 - protein, 8 aa, Artificial Sequence
  Description of Artificial Sequence: Synthetic peptide
GFTFDDYS

SEQ ID NO: 1014 - protein, 8 aa, Artificial Sequence
  Description of Artificial Sequence: Synthetic peptide
GFTFDDYA

SEQ ID NO: 1015 - protein, 8 aa, Artificial Sequence
  Description of Artificial Sequence: Synthetic peptide
GFTFDDYS

SEQ ID NO: 1016 - protein, 8 aa, Artificial Sequence
  Description of Artificial Sequence: Synthetic peptide
GFTFDDYA

SEQ ID NO: 1017 - protein, 8 aa, Artificial Sequence
  Description of Artificial Sequence: Synthetic peptide
GFTFDDYS

SEQ ID NO: 1018 - protein, 8 aa, Artificial Sequence
  Description of Artificial Sequence: Synthetic peptide
GFTFDDYS

SEQ ID NO: 1019 - protein, 8 aa, Artificial Sequence
  Description of Artificial Sequence: Synthetic peptide
GFTFDDYS

SEQ ID NO: 1020 - protein, 8 aa, Artificial Sequence
  Description of Artificial Sequence: Synthetic peptide
GFTFDDYS

SEQ ID NO: 1021 - protein, 8 aa, Artificial Sequence
  Description of Artificial Sequence: Synthetic peptide
GFTFDDYS

SEQ ID NO: 1022 - protein, 8 aa, Artificial Sequence
  Description of Artificial Sequence: Synthetic peptide
GFTFDDYS

SEQ ID NO: 1023 - protein, 8 aa, Artificial Sequence
  Description of Artificial Sequence: Synthetic peptide
GFTFDDYS

SEQ ID NO: 1024 - protein, 8 aa, Artificial Sequence
  Description of Artificial Sequence: Synthetic peptide
GFTFDDYS

SEQ ID NO: 1025 - protein, 8 aa, Artificial Sequence
  Description of Artificial Sequence: Synthetic peptide
GFTFDDYS

SEQ ID NO: 1026 - protein, 8 aa, Artificial Sequence
  Description of Artificial Sequence: Synthetic peptide
GFTFDDYS

SEQ ID NO: 1027 - protein, 8 aa, Artificial Sequence
  Description of Artificial Sequence: Synthetic peptide
GFTFDDYS

SEQ ID NO: 1028 - protein, 8 aa, Artificial Sequence
  Description of Artificial Sequence: Synthetic peptide
GFTFDDYS

SEQ ID NO: 1029 - protein, 8 aa, Artificial Sequence
  Description of Artificial Sequence: Synthetic peptide
GFTFDDYS

SEQ ID NO: 1030 - protein, 8 aa, Artificial Sequence
  Description of Artificial Sequence: Synthetic peptide
GFTFDDYS

SEQ ID NO: 1031 - protein, 8 aa, Artificial Sequence
  Description of Artificial Sequence: Synthetic peptide
GFTFDDYS

SEQ ID NO: 1032 - protein, 8 aa, Artificial Sequence
  Description of Artificial Sequence: Synthetic peptide
GFTFDDYS

SEQ ID NO: 1033 - protein, 8 aa, Artificial Sequence
  Description of Artificial Sequence: Synthetic peptide
ISWNSGSK

SEQ ID NO: 1034 - protein, 8 aa, Artificial Sequence
  Description of Artificial Sequence: Synthetic peptide
ISWNSGSI

SEQ ID NO: 1035 - protein, 8 aa, Artificial Sequence
  Description of Artificial Sequence: Synthetic peptide
ISWNSGSI

SEQ ID NO: 1036 - protein, 8 aa, Artificial Sequence
  Description of Artificial Sequence: Synthetic peptide
ISWNSGSI

SEQ ID NO: 1037 - protein, 8 aa, Artificial Sequence
  Description of Artificial Sequence: Synthetic peptide
ISWNSGSI

SEQ ID NO: 1038 - protein, 8 aa, Artificial Sequence
  Description of Artificial Sequence: Synthetic peptide
ISWNSGSI

SEQ ID NO: 1039 - protein, 8 aa, Artificial Sequence
  Description of Artificial Sequence: Synthetic peptide
ISWNSGSK

SEQ ID NO: 1040 - protein, 8 aa, Artificial Sequence
  Description of Artificial Sequence: Synthetic peptide
ISWNSGSK

SEQ ID NO: 1041 - protein, 8 aa, Artificial Sequence
  Description of Artificial Sequence: Synthetic peptide
ISWNSGSK

SEQ ID NO: 1042 - protein, 8 aa, Artificial Sequence
  Description of Artificial Sequence: Synthetic peptide
ISWNSGSI

SEQ ID NO: 1043 - protein, 8 aa, Artificial Sequence
  Description of Artificial Sequence: Synthetic peptide
ISWNSGSI

SEQ ID NO: 1044 - protein, 8 aa, Artificial Sequence
  Description of Artificial Sequence: Synthetic peptide
ISWNSGSI

SEQ ID NO: 1045 - protein, 8 aa, Artificial Sequence
  Description of Artificial Sequence: Synthetic peptide
ISWNSGSK

SEQ ID NO: 1046 - protein, 8 aa, Artificial Sequence
  Description of Artificial Sequence: Synthetic peptide
ISWNSGSK

SEQ ID NO: 1047 - protein, 8 aa, Artificial Sequence
  Description of Artificial Sequence: Synthetic peptide
ISWNSGSK

SEQ ID NO: 1048 - protein, 8 aa, Artificial Sequence
  Description of Artificial Sequence: Synthetic peptide
ISWNSGSI

SEQ ID NO: 1049 - protein, 8 aa, Artificial Sequence
  Description of Artificial Sequence: Synthetic peptide
ISWNSGSI

SEQ ID NO: 1050 - protein, 8 aa, Artificial Sequence
  Description of Artificial Sequence: Synthetic peptide
ISWNSGSI

SEQ ID NO: 1051 - protein, 8 aa, Artificial Sequence
  Description of Artificial Sequence: Synthetic peptide
ISWNSGSK

SEQ ID NO: 1052 - protein, 8 aa, Artificial Sequence
  Description of Artificial Sequence: Synthetic peptide
ISWNSGSK

SEQ ID NO: 1053 - protein, 17 aa, Artificial Sequence
  Description of Artificial Sequence: Synthetic peptide
AKYGSGYGKFYHYGLDV

SEQ ID NO: 1054 - protein, 17 aa, Artificial Sequence
  Description of Artificial Sequence: Synthetic peptide
AKDGSGYGYFYYYGMDV

SEQ ID NO: 1055 - protein, 17 aa, Artificial Sequence
  Description of Artificial Sequence: Synthetic peptide
AKDGSGYGYFYYYGMDV

SEQ ID NO: 1056 - protein, 17 aa, Artificial Sequence
  Description of Artificial Sequence: Synthetic peptide
AKDGSGYGKFYYYGMDV

SEQ ID NO: 1057 - protein, 17 aa, Artificial Sequence
  Description of Artificial Sequence: Synthetic peptide
AKDGSGYGKFYYYGMDV

SEQ ID NO: 1058 - protein, 17 aa, Artificial Sequence
  Description of Artificial Sequence: Synthetic peptide
AKYGSGYGKFYHYGLDV

SEQ ID NO: 1059 - protein, 17 aa, Artificial Sequence
  Description of Artificial Sequence: Synthetic peptide
AKDGSGYGKFYHYGLDV

SEQ ID NO: 1060 - protein, 17 aa, Artificial Sequence
  Description of Artificial Sequence: Synthetic peptide
AKYGSGYGKFYYYGLDV

SEQ ID NO: 1061 - protein, 17 aa, Artificial Sequence
  Description of Artificial Sequence: Synthetic peptide
AKYGSGYGKFYHYGMDV

SEQ ID NO: 1062 - protein, 17 aa, Artificial Sequence
  Description of Artificial Sequence: Synthetic peptide
AKDGSGYGKFYHYGLDV

SEQ ID NO: 1063 - protein, 17 aa, Artificial Sequence
  Description of Artificial Sequence: Synthetic peptide
AKYGSGYGKFYYYGLDV

SEQ ID NO: 1064 - protein, 17 aa, Artificial Sequence
  Description of Artificial Sequence: Synthetic peptide
AKYGSGYGKFYHYGMDV

SEQ ID NO: 1065 - protein, 17 aa, Artificial Sequence
  Description of Artificial Sequence: Synthetic peptide
AKDGSGYGKFYYYGLDV

SEQ ID NO: 1066 - protein, 17 aa, Artificial Sequence
  Description of Artificial Sequence: Synthetic peptide
AKDGSGYGKFYHYGMDV

SEQ ID NO: 1067 - protein, 17 aa, Artificial Sequence
  Description of Artificial Sequence: Synthetic peptide
AKYGSGYGKFYYYGMDV

SEQ ID NO: 1068 - protein, 17 aa, Artificial Sequence
  Description of Artificial Sequence: Synthetic peptide
AKDGSGYGKFYYYGLDV

SEQ ID NO: 1069 - protein, 17 aa, Artificial Sequence
  Description of Artificial Sequence: Synthetic peptide
AKDGSGYGKFYHYGMDV

SEQ ID NO: 1070 - protein, 17 aa, Artificial Sequence
  Description of Artificial Sequence: Synthetic peptide
AKYGSGYGKFYYYGMDV

SEQ ID NO: 1071 - protein, 17 aa, Artificial Sequence
  Description of Artificial Sequence: Synthetic peptide
AKDGSGYGKFYYYGMDV

SEQ ID NO: 1072 - protein, 17 aa, Artificial Sequence
  Description of Artificial Sequence: Synthetic peptide
AKYGSGYGKFYHYGLDV

SEQ ID NO: 1073 - protein, 108 aa, Artificial Sequence
  Description of Artificial Sequence: Synthetic polypeptide
DIQMTQSPSSLSASVGDSVTITCRASQSINNYLNWYQQKPGKAPKLLIYTASSLLSGVPSRFSGSGSGTDFTLTISGLHPEDFATYFCQQSFSTPPITFGQGTRLDIK

SEQ ID NO: 1074 - protein, 6 aa, Artificial Sequence
  Description of Artificial Sequence: Synthetic peptide
QSINNY

SEQ ID NO: 1075 - protein, 3 aa, Artificial Sequence
  Description of Artificial Sequence: Synthetic peptide
TAS

SEQ ID NO: 1076 - protein, 10 aa, Artificial Sequence
  Description of Artificial Sequence: Synthetic peptide
QQSFSTPPIT

SEQ ID NO: 1077 - protein, 122 aa, Artificial Sequence
  Description of Artificial Sequence: Synthetic polypeptide
QVQLVESGGGVVQPGRSLRLSCAASGFTFSTYGIHWVRQAPGKGLEWVAVILHDGSSNYYAESVKGRFIISRDNSKNTLYLQMNSLRAEDTALYYCTKRYSEAAGPNWFDPWGQGTLVTVSS

SEQ ID NO: 1078 - protein, 120 aa, Artificial Sequence
  Description of Artificial Sequence: Synthetic polypeptide
EVQLVESGGGLVQPGGSLRLSCAASGFTFSSYVMSWVRQAPGKGLEWVSAIIGSGGSTYYADSVKGRFTISRDNSKNTLYLQMNSLRAEDTAVYYCAKRAGDNWNWFDPWGQGTLVTVSS

SEQ ID NO: 1079 - protein, 117 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGNMGYADSVKGRFTISRDNAKNSLFLQMHSLRAEDTAFYYCAKVRLTAFDFWGQGTLVTVSS

SEQ ID NO: 1080 - protein, 118 aa, Artificial Sequence
  Description of Artificial Sequence: Synthetic polypeptide
QVQLVESGGGLVKPGGSLRLSCAASGFTFSDYYISWIRQAPGKGLEWVSYISSSGSSIKYADSVKGRFTISRDNAKNSLYLQMNSLRAEDTAVYYCAREGGNYGMDVWGQGTTVTVSS

SEQ ID NO: 1081 - protein, 125 aa, Artificial Sequence
  Description of Artificial Sequence: Synthetic polypeptide
EVQLVESGGGLVQPGGSLRLSCAASGFTFSNFWMTWVRQAPGKGLEWVANMNQDGSEKYYVDSVKGRFTISRDNAKSSLYLQMNSLRAEDTAVYYCARDREYCISTSCYDDFDYWGQGTLVTVSS

SEQ ID NO: 1082 - protein, 125 aa, Artificial Sequence
  Description of Artificial Sequence: Synthetic polypeptide
  21587N VH
QVQLQESGPGLVKPSETLSLTCTVSGGSINYYYWNWIRQPPGKGLEWIGYISYSGNTNYNPSLKSRVTISVATSRNQFSLTLSSVTAADTAVYYCARFAEYCGGNICYYYGMDVWGQGTTVTVSS

SEQ ID NO: 1083 - protein, 127 aa, Artificial Sequence
  Description of Artificial Sequence: Synthetic polypeptide
  21589N VH
QVQLVQSGAEVKRPGSSVKVSCKASGGTFSTYAINWVRQAPGQGLEWMGGIIPIFGTTNYAQKFQGRVTITTDGSTTTTYMELSSLRSEDTAVYYCARTVYDLNSKGYYYYYGLDVWGQGTTVTVSS

SEQ ID NO: 1084 - protein, 8 aa, Artificial Sequence
  Description of Artificial Sequence: Synthetic peptide
GFTFSTYG

SEQ ID NO: 1085 - protein, 8 aa, Artificial Sequence
  Description of Artificial Sequence: Synthetic peptide
GFTFSSYV

SEQ ID NO: 1086 - protein, 8 aa, Artificial Sequence
  Description of Artificial Sequence: Synthetic peptide
GFTFDDYA

SEQ ID NO: 1087 - protein, 8 aa, Artificial Sequence
  Description of Artificial Sequence: Synthetic peptide
GFTFSDYY

SEQ ID NO: 1088 - protein, 8 aa, Artificial Sequence
  Description of Artificial Sequence: Synthetic peptide
GFTFSNFW

SEQ ID NO: 1089 - protein, 8 aa, Artificial Sequence
  Description of Artificial Sequence: Synthetic peptide
ILHDGSSN

SEQ ID NO: 1090 - protein, 8 aa, Artificial Sequence
  Description of Artificial Sequence: Synthetic peptide
IIGSGGST

SEQ ID NO: 1091 - protein, 8 aa, Artificial Sequence
  Description of Artificial Sequence: Synthetic peptide
ISWNSGNM

SEQ ID NO: 1092 - protein, 8 aa, Artificial Sequence
  Description of Artificial Sequence: Synthetic peptide
ISSSGSSI

SEQ ID NO: 1093 - protein, 8 aa, Artificial Sequence
  Description of Artificial Sequence: Synthetic peptide
MNQDGSEK

SEQ ID NO: 1094 - protein, 15 aa, Artificial Sequence
  Description of Artificial Sequence: Synthetic peptide
TKRYSEAAGPNWFDP

SEQ ID NO: 1095 - protein, 13 aa, Artificial Sequence
  Description of Artificial Sequence: Synthetic peptide
AKRAGDNWNWFDP

SEQ ID NO: 1096 - protein, 10 aa, Artificial Sequence
  Description of Artificial Sequence: Synthetic peptide
AKVRLTAFDF

SEQ ID NO: 1097 - protein, 11 aa, Artificial Sequence
  Description of Artificial Sequence: Synthetic peptide
AREGGNYGMDV

SEQ ID NO: 1098 - protein, 18 aa, Artificial Sequence
  Description of Artificial Sequence: Synthetic peptide
ARDREYCISTSCYDDFDY

SEQ ID NO: 1099 - protein, 107 aa, Artificial Sequence
  Description of Artificial Sequence: Synthetic polypeptide
DIQMTQSPSSVSASVGDRVTITCRASRGISSWLAWYQQKPGKAPKLLIHAASSLQSGVPSRFSGSGSGTDFTLTISSLQPEDFATYYCQQAISFPFTFGPGTKVDIK

SEQ ID NO: 1100 - protein, 107 aa, Artificial Sequence
  Description of Artificial Sequence: Synthetic polypeptide
DIQMTQSPSSVSASLGDRVTITCRASQGISSWLAWYQRKPGKAPKLLIYAASSLQSGVPSRFSGSGSGADFTLTISSLQPEDFATYYCQQAKSVPFTFGPGTKVDIK

SEQ ID NO: 1101 - protein, 107 aa, Artificial Sequence
  Description of Artificial Sequence: Synthetic polypeptide
DIQMTQSPSSLSASVGDRVTITCRTSQSIGNYLNWFQQKPGKAPKLLIYTASSLQNGVPSRFTGSGSGTDFTLTISSLQPEDFVIYYCQQSFSTPYTFGQGTKLEIK

SEQ ID NO: 1102 - protein, 107 aa, Artificial Sequence
  Description of Artificial Sequence: Synthetic polypeptide
DIQMTQSPSSVSASVGDRVTITCRASQGINNWLVWYQQKPGKAPKLLIYAATSLQSGVPSRFSGSGSGTDFTLTISSLQPEDFATYYCQQANSFPPTFGQGTKLEIK

SEQ ID NO: 1103 - protein, 108 aa, Artificial Sequence
  Description of Artificial Sequence: Synthetic polypeptide
DIQMTQSPSSLSASVGDRVTITCRASQSISSYLNWYQQKPGKAPKLLIYAASSLHSGVPSRFSGSGSGTDFTLTISSLQPEDFATYYCQQSYSTPPITFGQGTRLEIK

SEQ ID NO: 1104 - protein, 108 aa, Artificial Sequence
  Description of Artificial Sequence: Synthetic polypeptide
  21587N VL (Non-germline Cys in CDR3)
EIVLTQSPGTLSLSPGERATFSCRASQSVGSSFLAWYQQKPGQAPRRLMYGASNRATGIPDRFSGSGSGTDFTLTISRLEPEDFAVYYCQQCGGSPWTFGQGTKVEIK

SEQ ID NO: 1105 - protein, 114 aa, Artificial Sequence
  Description of Artificial Sequence: Synthetic polypeptide
  21589N VL
DIVMTQTPLSLPVTPGEPASISCRSSQSLLDSDDGNTYLDWYLQKPGQSPQLLIYTLSYRASGVPDRFSGSGSGTDFTLKISRVEAEDVGIYYCMQRIEFPSLTFGGGTKVEIK

SEQ ID NO: 1106 - protein, 6 aa, Artificial Sequence
  Description of Artificial Sequence: Synthetic peptide
RGISSW

SEQ ID NO: 1107 - protein, 6 aa, Artificial Sequence
  Description of Artificial Sequence: Synthetic peptide
QGISSW

SEQ ID NO: 1108 - protein, 6 aa, Artificial Sequence
  Description of Artificial Sequence: Synthetic peptide
QSIGNY

SEQ ID NO: 1109 - protein, 6 aa, Artificial Sequence
  Description of Artificial Sequence: Synthetic peptide
QGINNW

SEQ ID NO: 1110 - protein, 6 aa, Artificial Sequence
  Description of Artificial Sequence: Synthetic peptide
QSISSY

SEQ ID NO: 1111 - protein, 3 aa, Artificial Sequence
  Description of Artificial Sequence: Synthetic peptide
AAS

SEQ ID NO: 1112 - protein, 3 aa, Artificial Sequence
  Description of Artificial Sequence: Synthetic peptide
AAS

SEQ ID NO: 1113 - protein, 3 aa, Artificial Sequence
  Description of Artificial Sequence: Synthetic peptide
TAS

SEQ ID NO: 1114 - protein, 3 aa, Artificial Sequence
  Description of Artificial Sequence: Synthetic peptide
AAT

SEQ ID NO: 1115 - protein, 3 aa, Artificial Sequence
  Description of Artificial Sequence: Synthetic peptide
AAS

SEQ ID NO: 1116 - protein, 9 aa, Artificial Sequence
  Description of Artificial Sequence: Synthetic peptide
QQAISFPFT

SEQ ID NO: 1117 - protein, 9 aa, Artificial Sequence
  Description of Artificial Sequence: Synthetic peptide
QQAKSVPFT

SEQ ID NO: 1118 - protein, 9 aa, Artificial Sequence
  Description of Artificial Sequence: Synthetic peptide
QQSFSTPYT

SEQ ID NO: 1119 - protein, 9 aa, Artificial Sequence
  Description of Artificial Sequence: Synthetic peptide
QQANSFPPT

SEQ ID NO: 1120 - protein, 10 aa, Artificial Sequence
  Description of Artificial Sequence: Synthetic peptide
QQSYSTPPIT

SEQ ID NO: 1121 - protein, 124 aa, Artificial Sequence; identical to SEQ ID NO: 319
  Description of Artificial Sequence: Synthetic polypeptide

SEQ ID NO: 1122 - protein, 124 aa, Artificial Sequence; identical to SEQ ID NO: 1010
  Description of Artificial Sequence: Synthetic polypeptide

SEQ ID NO: 1123 - protein, 8 aa, Artificial Sequence
  Description of Artificial Sequence: Synthetic peptide
GFTFDDYS

SEQ ID NO: 1124 - protein, 8 aa, Artificial Sequence
  Description of Artificial Sequence: Synthetic peptide
GFTFDDYS

SEQ ID NO: 1125 - protein, 8 aa, Artificial Sequence
  Description of Artificial Sequence: Synthetic peptide
ISWNSGSK

SEQ ID NO: 1126 - protein, 8 aa, Artificial Sequence
  Description of Artificial Sequence: Synthetic peptide
ISWNSGSI

SEQ ID NO: 1127 - protein, 17 aa, Artificial Sequence
  Description of Artificial Sequence: Synthetic peptide
AKYGSGYGKFYHYGLDV

SEQ ID NO: 1128 - protein, 17 aa, Artificial Sequence
  Description of Artificial Sequence: Synthetic peptide
AKYGSGYGKFYYYGMDV

SEQ ID NO: 1129 - protein, 108 aa, Artificial Sequence; identical to SEQ ID NO: 123
  Description of Artificial Sequence: Synthetic polypeptide

SEQ ID NO: 1130 - protein, 6 aa, Artificial Sequence
  Description of Artificial Sequence: Synthetic peptide
QSISSY

SEQ ID NO: 1131 - protein, 3 aa, Artificial Sequence
  Description of Artificial Sequence: Synthetic peptide
AAS

SEQ ID NO: 1132 - protein, 10 aa, Artificial Sequence
  Description of Artificial Sequence: Synthetic peptide
QQSYSTPPIT

SEQ ID NO: 1133 - protein, 207 aa, Artificial Sequence
  human CD3 Epsilon Protein (>NP_000724.1 T-cell surface glycoprotein CD3 epsilon chain precursor
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 1134 - protein, 171 aa, Artificial Sequence
  human CD3 Delta Protein (>NP_000723.1 T-cell surface glycoprotein CD3 delta chain isoform A precursor
MEHSTFLSGLVLATLLSQVSPFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 1135 - protein, 164 aa, Artificial Sequence
  human CD3 Zeta  Protein (>NP_932170.1 T-cell surface glycoprotein CD3 zeta chain isoform 1 precursor
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 1136 - protein, 182 aa, Artificial Sequence
  human CD3 Gamma Protein (>NP_000064.1 T-cell surface glycoprotein CD3 gamma chain precursor
MEQGKGLAVLILAIILLQGTLAQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 1137 - protein, 297 aa, Artificial Sequence
  human CD20 Protein
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 1138 - protein, 14507 aa, Artificial Sequence
  synthetic
MLKPSGLPGSSSPTRSLMTGSRSTKATPEMDSGLTGATLSPKTSTGAIVVTEHTLPFTSPDKTLASPTSSVVGRTTQSLGVMSSALPESTSRGMTHSEQRTSPSLSPQVNGTPSRNYPATSMVSGLSSPRTRTSSTEGNFTKEASTYTLTVETTSGPVTEKYTVPTETSTTEGDSTETPWDTRYIPVKITSPMKTFADSTASKENAPVSMTPAETTVTDSHTPGRTNPSFGTLYSSFLDLSPKGTPNSRGETSLELILSTTGYPFSSPEPGSAGHSRISTSAPLSSSASVLDNKISETSIFSGQSLTSPLSPGVPEARASTMPNSAIPFSMTLSNAETSAERVRSTISSLGTPSISTKQTAETILTFHAFAETMDIPSTHIAKTLASEWLGSPGTLGGTSTSALTTTSPSTTLVSEETNTHHSTSGKETEGTLNTSMTPLETSAPGEESEMTATLVPTLGFTTLDSKIRSPSQVSSSHPTRELRTTGSTSGRQSSSTAAHGSSDILRATTSSTSKASSWTSESTAQQFSEPQHTQWVETSPSMKTERPPASTSVAAPITTSVPSVVSGFTTLKTSSTKGIWLEETSADTLIGESTAGPTTHQFAVPTGISMTGGSSTRGSQGTTHLLTRATASSETSADLTLATNGVPVSVSPAVSKTAAGSSPPGGTKPSYTMVSSVIPETSSLQSSAFREGTSLGLTPLNTRHPFSSPEPDSAGHTKISTSIPLLSSASVLEDKVSATSTFSHHKATSSITTGTPEISTKTKPSSAVLSSMTLSNAATSPERVRNATSPLTHPSPSGEETAGSVLTLSTSAETTDSPNIHPTGTLTSESSESPSTLSLPSVSGVKTTFSSSTPSTHLFTSGEETEETSNPSVSQPETSVSRVRTTLASTSVPTPVFPTMDTWPTRSAQFSSSHLVSELRATSSTSVTNSTGSALPKISHLTGTATMSQTNRDTFNDSAAPQSTTWPETSPRFKTGLPSATTTVSTSATSLSATVMVSKFTSPATSSMEATSIREPSTTILTTETTNGPGSMAVASTNIPIGKGYITEGRLDTSHLPIGTTASSETSMDFTMAKESVSMSVSPSQSMDAAGSSTPGRTSQFVDTFSDDVYHLTSREITIPRDGTSSALTPQMTATHPPSPDPGSARSTWLGILSSSPSSPTPKVTMSSTFSTQRVTTSMIMDTVETSRWNMPNLPSTTSLTPSNIPTSGAIGKSTLVPLDTPSPATSLEASEGGLPTLSTYPESTNTPSIHLGAHASSESPSTIKLTMASVVKPGSYTPLTFPSIETHIHVSTARMAYSSGSSPEMTAPGETNTGSTWDPTTYITTTDPKDTSSAQVSTPHSVRTLRTTENHPKTESATPAAYSGSPKISSSPNLTSPATKAWTITDTTEHSTQLHYTKLAEKSSGFETQSAPGPVSVVIPTSPTIGSSTLELTSDVPGEPLVLAPSEQTTITLPMATWLSTSLTEEMASTDLDISSPSSPMSTFAIFPPMSTPSHELSKSEADTSAIRNTDSTTLDQHLGIRSLGRTGDLTTVPITPLTTTWTSVIEHSTQAQDTLSATMSPTHVTQSLKDQTSIPASASPSHLTEVYPELGTQGRSSSEATTFWKPSTDTLSREIETGPTNIQSTPPMDNTTTGSSSSGVTLGIAHLPIGTSSPAETSTNMALERRSSTATVSMAGTMGLLVTSAPGRSISQSLGRVSSVLSESTTEGVTDSSKGSSPRLNTQGNTALSSSLEPSYAEGSQMSTSIPLTSSPTTPDVEFIGGSTFWTKEVTTVMTSDISKSSARTESSSATLMSTALGSTENTGKEKLRTASMDLPSPTPSMEVTPWISLTLSNAPNTTDSLDLSHGVHTSSAGTLATDRSLNTGVTRASRLENGSDTSSKSLSMGNSTHTSMTYTEKSEVSSSIHPRPETSAPGAETTLTSTPGNRAISLTLPFSSIPVEEVISTGITSGPDINSAPMTHSPITPPTIVWTSTGTIEQSTQPLHAVSSEKVSVQTQSTPYVNSVAVSASPTHENSVSSGSSTSSPYSSASLESLDSTISRRNAITSWLWDLTTSLPTTTWPSTSLSEALSSGHSGVSNPSSTTTEFPLFSAASTSAAKQRNPETETHGPQNTAASTLNTDASSVTGLSETPVGASISSEVPLPMAITSRSDVSGLTSESTANPSLGTASSAGTKLTRTISLPTSESLVSFRMNKDPWTVSIPLGSHPTTNTETSIPVNSAGPPGLSTVASDVIDTPSDGAESIPTVSFSPSPDTEVTTISHFPEKTTHSFRTISSLTHELTSRVTPIPGDWMSSAMSTKPTGASPSITLGERRTITSAAPTTSPIVLTASFTETSTVSLDNETTVKTSDILDARKTNELPSDSSSSSDLINTSIASSTMDVTKTASISPTSISGMTASSSPSLFSSDRPQVPTSTTETNTATSPSVSSNTYSLDGGSNVGGTPSTLPPFTITHPVETSSALLAWSRPVRTFSTMVSTDTASGENPTSSNSVVTSVPAPGTWTSVGSTTDLPAMGFLKTSPAGEAHSLLASTIEPATAFTPHLSAAVVTGSSATSEASLLTTSESKAIHSSPQTPTTPTSGANWETSATPESLLVVTETSDTTLTSKILVTDTILFSTVSTPPSKFPSTGTLSGASFPTLLPDTPAIPLTATEPTSSLATSFDSTPLVTIASDSLGTVPETTLTMSETSNGDALVLKTVSNPDRSIPGITIQGVTESPLHPSSTSPSKIVAPRNTTYEGSITVALSTLPAGTTGSLVFSQSSENSETTALVDSSAGLERASVMPLTTGSQGMASSGGIRSGSTHSTGTKTFSSLPLTMNPGEVTAMSEITTNRLTATQSTAPKGIPVKPTSAESGLLTPVSASSSPSKAFASLTTAPPTWGIPQSTLTFEFSEVPSLDTKSASLPTPGQSLNTIPDSDASTASSSLSKSPEKNPRARMMTSTKAISASSFQSTGFTETPEGSASPSMAGHEPRVPTSGTGDPRYASESMSYPDPSKASSAMTSTSLASKLTTLFSTGQAARSGSSSSPISLSTEKETSFLSPTASTSRKTSLFLGPSMARQPNILVHLQTSALTLSPTSTLNMSQEEPPELTSSQTIAEEEGTTAETQTLTFTPSETPTSLLPVSSPTEPTARRKSSPETWASSISVPAKTSLVETTDGTLVTTIKMSSQAAQGNSTWPAPAEETGSSPAGTSPGSPEMSTTLKIMSSKEPSISPEIRSTVRNSPWKTPETTVPMETTVEPVTLQSTALGSGSTSISHLPTGTTSPTKSPTENMLATERVSLSPSPPEAWTNLYSGTPGGTRQSLATMSSVSLESPTARSITGTGQQSSPELVSKTTGMEFSMWHGSTGGTTGDTHVSLSTSSNILEDPVTSPNSVSSLTDKSKHKTETWVSTTAIPSTVLNNKIMAAEQQTSRSVDEAYSSTSSWSDQTSGSDITLGASPDVTNTLYITSTAQTTSLVSLPSGDQGITSLTNPSGGKTSSASSVTSPSIGLETLRANVSAVKSDIAPTAGHLSQTSSPAEVSILDVTTAPTPGISTTITTMGTNSISTTTPNPEVGMSTMDSTPATERRTTSTEHPSTWSSTAASDSWTVTDMTSNLKVARSPGTISTMHTTSFLASSTELDSMSTPHGRITVIGTSLVTPSSDASAVKTETSTSERTLSPSDTTASTPISTFSRVQRMSISVPDILSTSWTPSSTEAEDVPVSMVSTDHASTKTDPNTPLSTFLFDSLSTLDWDTGRSLSSATATTSAPQGATTPQELTLETMISPATSQLPFSIGHITSAVTPAAMARSSGVTFSRPDPTSKKAEQTSTQLPTTTSAHPGQVPRSAATTLDVIPHTAKTPDATFQRQGQTALTTEARATSDSWNEKEKSTPSAPWITEMMNSVSEDTIKEVTSSSSVLRTLNTLDINLESGTTSSPSWKSSPYERIAPSESTTDKEAIHPSTNTVETTGWVTSSEHASHSTIPAHSASSKLTSPVVTTSTREQAIVSMSTTTWPESTRARTEPNSFLTIELRDVSPYMDTSSTTQTSIISSPGSTAITKGPRTEITSSKRISSSFLAQSMRSSDSPSEAITRLSNFPAMTESGGMILAMQTSPPGATSLSAPTLDTSATASWTGTPLATTQRFTYSEKTTLFSKGPEDTSQPSPPSVEETSSSSSLVPIHATTSPSNILLTSQGHSPSSTPPVTSVFLSETSGLGKTTDMSRISLEPGTSLPPNLSSTAGEALSTYEASRDTKAIHHSADTAVTNMEATSSEYSPIPGHTKPSKATSPLVTSHIMGDITSSTSVFGSSETTEIETVSSVNQGLQERSTSQVASSATETSTVITHVSSGDATTHVTKTQATFSSGTSISSPHQFITSTNTFTDVSTNPSTSLIMTESSGVTITTQTGPTGAATQGPYLLDTSTMPYLTETPLAVTPDFMQSEKTTLISKGPKDVSWTSPPSVAETSYPSSLTPFLVTTIPPATSTLQGQHTSSPVSATSVLTSGLVKTTDMLNTSMEPVTNSPQNLNNPSNEILATLAATTDIETIHPSINKAVTNMGTASSAHVLHSTLPVSSEPSTATSPMVPASSMGDALASISIPGSETTDIEGEPTSSLTAGRKENSTLQEMNSTTESNIILSNVSVGAITEATKMEVPSFDATFIPTPAQSTKFPDIFSVASSRLSNSPPMTISTHMTTTQTGSSGATSKIPLALDTSTLETSAGTPSVVTEGFAHSKITTAMNNDVKDVSQTNPPFQDEASSPSSQAPVLVTTLPSSVAFTPQWHSTSSPVSMSSVLTSSLVKTAGKVDTSLETVTSSPQSMSNTLDDISVTSAATTDIETTHPSINTVVTNVGTTGSAFESHSTVSAYPEPSKVTSPNVTTSTMEDTTISRSIPKSSKTTRTETETTSSLTPKLRETSISQEITSSTETSTVPYKELTGATTEVSRTDVTSSSSTSFPGPDQSTVSLDISTETNTRLSTSPIMTESAEITITTQTGPHGATSQDTFTMDPSNTTPQAGIHSAMTHGFSQLDVTTLMSRIPQDVSWTSPPSVDKTSSPSSFLSSPAMTTPSLISSTLPEDKLSSPMTSLLTSGLVKITDILRTRLEPVTSSLPNFSSTSDKILATSKDSKDTKEIFPSINTEETNVKANNSGHESHSPALADSETPKATTQMVITTTVGDPAPSTSMPVHGSSETTNIKREPTYFLTPRLRETSTSQESSFPTDTSFLLSKVPTGTITEVSSTGVNSSSKISTPDHDKSTVPPDTFTGEIPRVFTSSIKTKSAEMTITTQASPPESASHSTLPLDTSTTLSQGGTHSTVTQGFPYSEVTTLMGMGPGNVSWMTTPPVEETSSVSSLMSSPAMTSPSPVSSTSPQSIPSSPLPVTALPTSVLVTTTDVLGTTSPESVTSSPPNLSSITHERPATYKDTAHTEAAMHHSTNTAVTNVGTSGSGHKSQSSVLADSETSKATPLMSTTSTLGDTSVSTSTPNISQTNQIQTEPTASLSPRLRESSTSEKTSSTTETNTAFSYVPTGAITQASRTEISSSRTSISDLDRPTIAPDISTGMITRLFTSPIMTKSAEMTVTTQTTTPGATSQGILPWDTSTTLFQGGTHSTVSQGFPHSEITTLRSRTPGDVSWMTTPPVEETSSGFSLMSPSMTSPSPVSSTSPESIPSSPLPVTALLTSVLVTTTNVLGTTSPEPVTSSPPNLSSPTQERLTTYKDTAHTEAMHASMHTNTAVANVGTSISGHESQSSVPADSHTSKATSPMGITFAMGDTSVSTSTPAFFETRIQTESTSSLIPGLRDTRTSEEINTVTETSTVLSEVPTTTTTEVSRTEVITSSRTTISGPDHSKMSPYISTETITRLSTFPFVTGSTEMAITNQTGPIGTISQATLTLDTSSTASWEGTHSPVTQRFPHSEETTTMSRSTKGVSWQSPPSVEETSSPSSPVPLPAITSHSSLYSAVSGSSPTSALPVTSLLTSGRRKTIDMLDTHSELVTSSLPSASSFSGEILTSEASTNTETIHFSENTAETNMGTTNSMHKLHSSVSIHSQPSGHTPPKVTGSMMEDAIVSTSTPGSPETKNVDRDSTSPLTPELKEDSTALVMNSTTESNTVFSSVSLDAATEVSRAEVTYYDPTFMPASAQSTKSPDISPEASSSHSNSPPLTISTHKTIATQTGPSGVTSLGQLTLDTSTIATSAGTPSARTQDFVDSETTSVMNNDLNDVLKTSPFSAEEANSLSSQAPLLVTTSPSPVTSTLQEHSTSSLVSVTSVPTPTLAKITDMDTNLEPVTRSPQNLRNTLATSEATTDTHTMHPSINTAVANVGTTSSPNEFYFTVSPDSDPYKATSAVVITSTSGDSIVSTSMPRSSAMKKIESETTFSLIFRLRETSTSQKIGSSSDTSTVFDKAFTAATTEVSRTELTSSSRTSIQGTEKPTMSPDTSTRSVTMLSTFAGLTKSEERTIATQTGPHRATSQGTLTWDTSITTSQAGTHSAMTHGFSQLDLSTLTSRVPEYISGTSPPSVEKTSSSSSLLSLPAITSPSPVPTTLPESRPSSPVHLTSLPTSGLVKTTDMLASVASLPPNLGSTSHKIPTTSEDIKDTEKMYPSTNIAVTNVGTTTSEKESYSSVPAYSEPPKVTSPMVTSFNIRDTIVSTSMPGSSEITRIEMESTFSLAHGLKGTSTSQDPIVSTEKSAVLHKLTTGATETSRTEVASSRRTSIPGPDHSTESPDISTEVIPSLPISLGITESSNMTIITRTGPPLGSTSQGTFTLDTPTTSSRAGTHSMATQEFPHSEMTTVMNKDPEILSWTIPPSIEKTSFSSSLMPSPAMTSPPVSSTLPKTIHTTPSPMTSLLTPSLVMTTDTLGTSPEPTTSSPPNLSSTSHEILTTDEDTTAIEAMHPSTSTAATNVETTSSGHGSQSSVLADSEKTKATAPMDTTSTMGHTTVSTSMSVSSETTKIKRESTYSLTPGLRETSISQNASFSTDTSIVLSEVPTGTTAEVSRTEVTSSGRTSIPGPSQSTVLPEISTRTMTRLFASPTMTESAEMTIPTQTGPSGSTSQDTLTLDTSTTKSQAKTHSTLTQRFPHSEMTTLMSRGPGDMSWQSSPSLENPSSLPSLLSLPATTSPPPISSTLPVTISSSPLPVTSLLTSSPVTTTDMLHTSPELVTSSPPKLSHTSDERLTTGKDTTNTEAVHPSTNTAASNVEIPSSGHESPSSALADSETSKATSPMFITSTQEDTTVAISTPHFLETSRIQKESISSLSPKLRETGSSVETSSAIETSAVLSEVSIGATTEISRTEVTSSSRTSISGSAESTMLPEISTTRKIIKFPTSPILAESSEMTIKTQTSPPGSTSESTFTLDTSTTPSLVITHSTMTQRLPHSEITTLVSRGAGDVPRPSSLPVEETSPPSSQLSLSAMISPSPVSSTLPASSHSSSASVTSLLTPGQVKTTEVLDASAEPETSSPPSLSSTSVEILATSEVTTDTEKIHPFSNTAVTKVGTSSSGHESPSSVLPDSETTKATSAMGTISIMGDTSVSTLTPALSNTRKIQSEPASSLTTRLRETSTSEETSLATEANTVLSKVSTGATTEVSRTEAISFSRTSMSGPEQSTMSQDISIGTIPRISASSVLTESAKMTITTQTGPSESTLESTLNLNTATTPSWVETHSIVIQGFPHPEMTTSMGRGPGGVSWPSPPFVKETSPPSSPLSLPAVTSPHPVSTTFLAHIPPSPLPVTSLLTSGPATTTDILGTSTEPGTSSSSSLSTTSHERLTTYKDTAHTEAVHPSTNTGGTNVATTSSGYKSQSSVLADSSPMCTTSTMGDTSVLTSTPAFLETRRIQTELASSLTPGLRESSGSEGTSSGTKMSTVLSKVPTGATTEISKEDVTSIPGPAQSTISPDISTRTVSWFSTSPVMTESAEITMNTHTSPLGATTQGTSTLDTSSTTSLTMTHSTISQGFSHSQMSTLMRRGPEDVSWMSPPLLEKTRPSFSLMSSPATTSPSPVSSTLPESISSSPLPVTSLLTSGLAKTTDMLHKSSEPVTNSPANLSSTSVEILATSEVTTDTEKTHPSSNRTVTDVGTSSSGHESTSFVLADSQTSKVTSPMVITSTMEDTSVSTSTPGFFETSRIQTEPTSSLTLGLRKTSSSEGTSLATEMSTVLSGVPTGATAEVSRTEVTSSSRTSISGFAQLTVSPETSTETITRLPTSSIMTESAEMMIKTQTDPPGSTPESTHTVDISTTPNWVETHSTVTQRFSHSEMTTLVSRSPGDMLWPSQSSVEETSSASSLLSLPATTSPSPVSSTLVEDFPSASLPVTSLLNPGLVITTDRMGISREPGTSSTSNLSSTSHERLTTLEDTVDTEDMQPSTHTAVTNVRTSISGHESQSSVLSDSETPKATSPMGTTYTMGETSVSISTSDFFETSRIQIEPTSSLTSGLRETSSSERISSATEGSTVLSEVPSGATTEVSRTEVISSRGTSMSGPDQFTISPDISTEAITRLSTSPIMTESAESAITIETGSPGATSEGTLTLDTSTTTFWSGTHSTASPGFSHSEMTTLMSRTPGDVPWPSLPSVEEASSVSSSLSSPAMTSTSFFSTLPESISSSPHPVTALLTLGPVKTTDMLRTSSEPETSSPPNLSSTSAEILATSEVTKDREKIHPSSNTPVVNVGTVIYKHLSPSSVLADLVTTKPTSPMATTSTLGNTSVSTSTPAFPETMMTQPTSSLTSGLREISTSQETSSATERSASLSGMPTGATTKVSRTEALSLGRTSTPGPAQSTISPEISTETITRISTPLTTTGSAEMTITPKTGHSGASSQGTFTLDTSSRASWPGTHSAATHRSPHSGMTTPMSRGPEDVSWPSRPSVEKTSPPSSLVSLSAVTSPSPLYSTPSESSHSSPLRVTSLFTPVMMKTTDMLDTSLEPVTTSPPSMNITSDESLATSKATMETEAIQLSENTAVTQMGTISARQEFYSSYPGLPEPSKVTSPVVTSSTIKDIVSTTIPASSEITRIEMESTSTLTPTPRETSTSQEIHSATKPSTVPYKALTSATIEDSMTQVMSSSRGPSPDQSTMSQDISTEVITRLSTSPIKTESTEMTITTQTGSPGATSRGTLTLDTSTTFMSGTHSTASQGFSHSQMTALMSRTPGDVPWLSHPSVEEASSASFSLSSPVMTSSSPVSSTLPDSIHSSSLPVTSLLTSGLVKTTELLGTSSEPETSSPPNLSSTSAEILAITEVTTDTEKLEMTNVVTSGYTHESPSSVLADSVTTKATSSMGITYPTGDTNVLTSTPAFSDTSRIQTKSKLSLTPGLMETSISEETSSATEKSTVLSSVPTGATTEVSRTEAISSSRTSIPGPAQSTMSSDTSMETITRISTPLTRKESTDMAITPKTGPSGATSQGTFTLDSSSTASWPGTHSATTQRFPQSVVTTPMSRGPEDVSWPSPLSVEKNSPPSSLVSSSSVTSPSPLYSTPSGSSHSSPVPVTSLFTSIMMKATDMLDASLEPETTSAPNMNITSDESLAASKATTETEAIHVFENTAASHVETTSATEELYSSSPGFSEPTKVISPVVTSSSIRDNMVSTTMPGSSGITRIEIESMSSLTPGLRETRTSQDITSSTETSTVLYKMPSGATPEVSRTEVMPSSRTSIPGPAQSTMSLDISDEVVTRLSTSPIMTESAEITITTQTGYSLATSQVTLPLGTSMTFLSGTHSTMSQGLSHSEMTNLMSRGPESLSWTSPRFVETTRSSSSLTSLPLTTSLSPVSSTLLDSSPSSPLPVTSLILPGLVKTTEVLDTSSEPKTSSSPNLSSTSVEIPATSEIMTDTEKIHPSSNTAVAKVRTSSSVHESHSSVLADSETTITIPSMGITSAVDDTTVFTSNPAFSETRRIPTEPTFSLTPGFRETSTSEETTSITETSAVLYGVPTSATTEVSMTEIMSSNRIHIPDSDQSTMSPDIITEVITRLSSSSMMSESTQMTITTQKSSPGATAQSTLTLATTTAPLARTHSTVPPRFLHSEMTTLMSRSPENPSWKSSLFVEKTSSSSSLLSLPVTTSPSVSSTLPQSIPSSSFSVTSLLTPGMVKTTDTSTEPGTSLSPNLSGTSVEILAASEVTTDTEKIHPSSSMAVTNVGTTSSGHELYSSVSIHSEPSKATYPVGTPSSMAETSISTSMPANFETTGFEAEPFSHLTSGFRKTNMSLDTSSVTPTNTPSSPGSTHLLQSSKTDFTSSAKTSSPDWPPASQYTEIPVDIITPFNASPSITESTGITSFPESRFTMSVTESTHHLSTDLLPSAETISTGTVMPSLSEAMTSFATTGVPRAISGSGSPFSRTESGPGDATLSTIAESLPSSTPVPFSSSTFTTTDSSTIPALHEITSSSATPYRVDTSLGTESSTTEGRLVMVSTLDTSSQPGRTSSSPILDTRMTESVELGTVTSAYQVPSLSTRLTRTDGIMEHITKIPNEAAHRGTIRPVKGPQTSTSPASPKGLHTGGTKRMETTTTALKTTTTALKTTSRATLTTSVYTPTLGTLTPLNASMQMASTIPTEMMITTPYVFPDVPETTSSLATSLGAETSTALPRTTPSVFNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHPAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTSLVTSSRAVTSTTIPTLTISSDEPETTTSLVTHSEAKMISAIPTLAVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPGASKMLTSLVISSGTDSTTTFPTLTETPYEPETTAIQLIHPAETNTMVPRTTPKFSHSKSDTTLPVAITSPGPEASSAVSTTTISPDMSDLVTSLVPSSGTDTSTTFPTLSETPYEPETTATWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTETSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSATAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTSSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGVDREQLYWELSQLTNGIKELGPYTLDRNSLYVNGFTHWIPVPTSSTPGTSTVDLGSGTPSSLPSPTTAGPLLVPFTLNFTITNLKYEEDMHCPGSRKFNTTERVLQSLLGPMFKNTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTTGPLLVPFTLNFTITNLQYEENMGHPGSRKFNITESVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTITNLQYEEDMRRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPMTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGPYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGCRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMQHLLSPLFQRSSLGARYTGCRVIALRSVKNGAETRVDLLCTYLQPLSGPGLPIKQVFHELSQQTHGITRLGPYSLDKDSLYLNGYNEPGPDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGVITCLICGVLVTTRRRKKEGEYNVQQQCPGYYQSHLDLEDLQ

SEQ ID NO: 1139 - protein, 184 aa, Artificial Sequence
  human BCMA (TNFRSF17) Protein NP_001183.2
MLQMAGQCSQNEYFDSLLHACIPCQLRCSSNTPPLTCQRYCNASVTNSVKGTNAILWTCLGLSLIISLAVFVLMFLLRKINSEPLKDEFKNTGSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 1140 - protein, 750 aa, Artificial Sequence
  human PSMA (FOLH1) Protein
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 1141 - protein, 490 aa, Homo sapiens
  human STEAP2 (STAMP1) Protein
MESISMMGSPKSLSETFLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTLWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQVHANIENSWNEEEVWRIEMYISFGIMSLGLLSLLAVTSIPSVSNALNWREFSFIQSTLGYVALLISTFHVLIYGWKRAFEEEYYRFYTPPNFVLALVLPSIVILGKIILFLPCISRKLKRIKKGWEKSQFLEEGMGGTIPHVSPERVTVM

SEQ ID NO: 1142 - protein, 297 aa, Artificial Sequence; identical to SEQ ID NO: 1137
  hCD20

SEQ ID NO: 1143 - protein, 127 aa, Artificial Sequence
  Synthetic
EVQLVESGGGLVQPGRSLRLSCVASGFTFNDYAMHWVRQAPGKGLEWVSVISWNSDSIGYADSVKGRFTISRDNAKNSLYLQMHSLRAEDTALYYCAKDNHYGSGSYYYYQYGMDVWGQGTTVTVSS

SEQ ID NO: 1144 - protein, 8 aa, Artificial Sequence
  Synthetic
GFTFNDYA

SEQ ID NO: 1145 - protein, 8 aa, Artificial Sequence
  Synthetic
ISWNSDSI

SEQ ID NO: 1146 - protein, 20 aa, Artificial Sequence
  Synthetic
AKDNHYGSGSYYYYQYGMDV

SEQ ID NO: 1147 - protein, 123 aa, Artificial Sequence; identical to SEQ ID NO: 240
  Synthetic

SEQ ID NO: 1148 - protein, 8 aa, Artificial Sequence
  Synthetic
GFTFDDYT

SEQ ID NO: 1149 - protein, 8 aa, Artificial Sequence
  Synthetic
ISWNSGSI

SEQ ID NO: 1150 - protein, 16 aa, Artificial Sequence
  Synthetic
AKDNSGYGHYYYGMDV

SEQ ID NO: 1151 - protein, 108 aa, Artificial Sequence; identical to SEQ ID NO: 969
  Synthetic

SEQ ID NO: 1152 - protein, 6 aa, Artificial Sequence
  Synthetic
QSVSSN

SEQ ID NO: 1153 - protein, 3 aa, Artificial Sequence
  Synthetic
GAS

SEQ ID NO: 1154 - protein, 9 aa, Artificial Sequence
  Synthetic
QHYINWPLT

SEQ ID NO: 1155 - protein, 123 aa, Artificial Sequence; identical to SEQ ID NO: 233
  Synthetic

SEQ ID NO: 1156 - protein, 8 aa, Artificial Sequence
  Synthetic
GFTFDDFT

SEQ ID NO: 1157 - protein, 8 aa, Artificial Sequence
  Synthetic
ISWNSGSI

SEQ ID NO: 1158 - protein, 16 aa, Artificial Sequence
  Synthetic
AKDNSGYGYYYYGMDV

SEQ ID NO: 1159 - protein, 107 aa, Artificial Sequence; identical to SEQ ID NO: 589
  Synthetic

SEQ ID NO: 1160 - protein, 6 aa, Artificial Sequence
  Synthetic
HSVSRN

SEQ ID NO: 1161 - protein, 3 aa, Artificial Sequence
  Synthetic
GAS

SEQ ID NO: 1162 - protein, 9 aa, Artificial Sequence
  Synthetic
QQYNNWPLT

SEQ ID NO: 1163 - protein, 123 aa, Artificial Sequence; identical to SEQ ID NO: 240
  Synthetic

SEQ ID NO: 1164 - protein, 8 aa, Artificial Sequence
  Synthetic
GFTFDDYT

SEQ ID NO: 1165 - protein, 8 aa, Artificial Sequence
  Synthetic
ISWNSGSI

SEQ ID NO: 1166 - protein, 16 aa, Artificial Sequence
  Synthetic
AKDNSGYGHYYYGMDV

SEQ ID NO: 1167 - protein, 107 aa, Artificial Sequence; identical to SEQ ID NO: 596
  Synthetic

SEQ ID NO: 1168 - protein, 6 aa, Artificial Sequence
  Synthetic
QSVSSN

SEQ ID NO: 1169 - protein, 3 aa, Artificial Sequence
  Synthetic
GAS

SEQ ID NO: 1170 - protein, 9 aa, Artificial Sequence
  Synthetic
QHYINWPLT

SEQ ID NO: 1171 - protein, 118 aa, Artificial Sequence; identical to SEQ ID NO: 244
  Synthetic

SEQ ID NO: 1172 - protein, 8 aa, Artificial Sequence
  Synthetic
GFTFRSYA

SEQ ID NO: 1173 - protein, 8 aa, Artificial Sequence
  Synthetic
VYYDGNNQ

SEQ ID NO: 1174 - protein, 11 aa, Artificial Sequence
  Synthetic
ARGPGYNWLDP

SEQ ID NO: 1175 - protein, 107 aa, Artificial Sequence; identical to SEQ ID NO: 600
  Synthetic

SEQ ID NO: 1176 - protein, 6 aa, Artificial Sequence
  Synthetic
QSVSRN

SEQ ID NO: 1177 - protein, 3 aa, Artificial Sequence
  Synthetic
GAS

SEQ ID NO: 1178 - protein, 9 aa, Artificial Sequence
  Synthetic
QQYNNWPLT

SEQ ID NO: 1179 - protein, 118 aa, Artificial Sequence; identical to SEQ ID NO: 243
  Synthetic

SEQ ID NO: 1180 - protein, 8 aa, Artificial Sequence
  Synthetic
GFTFRSYG

SEQ ID NO: 1181 - protein, 8 aa, Artificial Sequence
  Synthetic
IYYDGKNK

SEQ ID NO: 1182 - protein, 11 aa, Artificial Sequence
  Synthetic
ARGPGYNWLDP

SEQ ID NO: 1183 - protein, 107 aa, Artificial Sequence; identical to SEQ ID NO: 599
  Synthetic

SEQ ID NO: 1184 - protein, 6 aa, Artificial Sequence
  Synthetic
QRISSN

SEQ ID NO: 1185 - protein, 3 aa, Artificial Sequence
  Synthetic
GAS

SEQ ID NO: 1186 - protein, 9 aa, Artificial Sequence
  Synthetic
QQHHNWPLT

SEQ ID NO: 1187 - protein, 119 aa, Artificial Sequence; identical to SEQ ID NO: 950
  Synthetic

SEQ ID NO: 1188 - protein, 8 aa, Artificial Sequence
  Synthetic
GYTFTRYT

SEQ ID NO: 1189 - protein, 8 aa, Artificial Sequence
  Synthetic
INPSRGYT

SEQ ID NO: 1190 - protein, 12 aa, Artificial Sequence
  Synthetic
ARYYDDHYCLDY

SEQ ID NO: 1191 - protein, 106 aa, Artificial Sequence; identical to SEQ ID NO: 974
  Synthetic

SEQ ID NO: 1192 - protein, 11 aa, Artificial Sequence
  Synthetic
LSCRASQSVSY

SEQ ID NO: 1193 - protein, 3 aa, Artificial Sequence
  Synthetic
DTS

SEQ ID NO: 1194 - protein, 9 aa, Artificial Sequence
  Synthetic
QQWSSNPLT

What is claimed is:

1. A method of treating cancer and inhibiting cytokine release syndrome in a subject, comprising conjointly administering to the subject:
   (a) a multi-specific antigen binding molecule comprising a first antigen-binding domain that specifically binds to CD3 and a second antigen-binding domain that specifically binds to a tumor antigen; and
   (b) a CD40 antagonist or a CAR-T cell expressing a CD40 antagonist, wherein the CD40 antagonist is an antibody or antigen-binding fragment thereof.

2. The method of claim 1, wherein the multi-specific antigen binding molecule is a bispecific or a tri-specific antigen binding molecule.

3. The method of claim 2, wherein the multi-specific antigen binding molecule is a tri-specific antigen binding molecule, and the tri-specific antigen binding molecule further comprises a third antigen-binding domain that specifically binds an additional T cell antigen or an additional tumor antigen.

4. The method of claim 3, wherein the third antigen-binding domain specifically binds CD28.

5. The method of claim 1, wherein the tumor antigen is selected from CD19, CD123, STEAP2, CD20, SSTR2, CD38, STEAP1, 5T4, ENPP3, PSMA, MUC16, GPRC5D, and BCMA.

6. The method of claim 1, wherein the multi-specific antigen binding molecule comprises a multi-specific antibody or antigen-binding fragment thereof.

7. The method of claim 1, wherein the multi-specific antigen binding molecule is selected from a bispecific CD3×CD19 antibody, a bispecific CD3×GPRC5D antibody, a bispecific CD3×CD123 antibody, a bispecific CD3×STEAP2 antibody, a bispecific CD3×CD20 antibody, a bispecific CD3×SSTR 2 antibody, a bispecific CD3×CD38 antibody, a bispecific CD3×STEAP1 antibody, a bispecific CD3×5T4 antibody, a bispecific CD3×ENPP3 antibody, a bispecific CD3×MUC16 antibody, a bispecific CD3×BCMA antibody, a bispecific CD3×PSMA antibody, and a trispecific CD3×CD28×CD38 antibody.

8. The method of claim 1, wherein the method comprises conjointly administering to the subject the multi-specific antigen binding molecule and the CD40 antagonist.

9. The method of claim 1, wherein the method comprises conjointly administering to the subject the multi-specific antigen binding molecule and the CAR-T cell expressing the CD40 antagonist, and wherein the CAR-T cell secretes the CD40 antagonist.

10. The method of claim 9, wherein the CD40 antagonist is a scFv or Fab.

11. The method of claim 1, wherein the cytokine release syndrome is inhibited as measured by keeping C-reactive protein (CRP) level below 7 mg/dL, IFN-γ below 75 pg/ml, or IL-10 below 60 pg/ml.

12. A method of inhibiting cytokine release syndrome caused by a multi-specific antigen binding molecule comprising a first antigen-binding domain that specifically binds CD3 and a second antigen-binding domain that specifically binds a tumor antigen in a subject, comprising administering to the subject a CD40 antagonist or a CAR-T cell expressing an CD40 antagonist, wherein the CD40 antagonist is an antibody or antigen-binding fragment thereof.

13. The method of claim 12, wherein the multi-specific antigen binding molecule is a bispecific or a tri-specific antigen binding molecule.

14. The method of claim 13, wherein the multi-specific antigen binding molecule is a tri-specific antigen binding molecule, and the tri-specific antigen binding molecule further comprises a third antigen-binding domain that specifically binds an additional T cell antigen or an additional tumor antigen.

15. The method of claim 14, wherein the third antigen-binding domain specifically binds CD28.

16. The method of claim 12, wherein the tumor antigen is selected from CD19, CD123, STEAP2, CD20, SSTR2, CD38, STEAP1, 5T4, ENPP3, PSMA, MUC16, GPRC5D, and BCMA.

17. The method of claim 12, wherein the multi-specific antigen binding molecule comprises a multi-specific antibody or antigen-binding fragment thereof.

18. The method of claim 12, wherein the multi-specific antigen binding molecule is selected from a bispecific CD3×CD19 antibody, a bispecific CD3×GPRC5D antibody, a bispecific CD3×CD123 antibody, a bispecific CD3×STEAP2 antibody, a bispecific CD3×CD20 antibody, a bispecific CD3×SSTR 2 antibody, a bispecific CD3×CD38 antibody, a bispecific CD3×STEAP1 antibody, a bispecific CD3×5T4 antibody, a bispecific CD3×ENPP3 antibody, a bispecific CD3×MUC16 antibody, a bispecific CD3×BCMA antibody, a bispecific CD3×PSMA antibody, and a trispecific CD3×CD28×CD38 antibody.

19. The method of claim 12, wherein the method comprises conjointly administering to the subject the multi-specific antigen binding molecule and the CD40 antagonist.

20. The method of claim 12, wherein the method comprises conjointly administering to the subject the multi-specific antigen binding molecule and the CAR-T cell expressing the CD40 antagonist, and wherein the CAR-T cell secretes the CD40 antagonist.

21. The method of claim 20, wherein the CD40 antagonist is a scFv or Fab.

22. The method of claim 12, wherein the method further comprises identifying a subject that is susceptible to cytokine release syndrome or in need of reduction in cytokine release prior to administering to the subject the CD40 antagonist or the CAR-T cell expressing the CD40 antagonist.

23. A pharmaceutical composition comprising:
   (a) a multi-specific antigen binding molecule comprising a first antigen-binding domain that specifically binds CD3 and a second antigen-binding domain that specifically binds a tumor antigen; and
   (b) a CD40 antagonist, wherein the CD40 antagonist is an antibody or antigen-binding fragment thereof.

24. The pharmaceutical composition of claim 23, wherein the multi-specific antigen binding molecule is a bispecific or a tri-specific antigen binding molecule.

25. The pharmaceutical composition of claim 24, wherein the multi-specific antigen binding molecule is a tri-specific antigen binding molecule, and the tri-specific antigen binding molecule further comprises a third antigen-binding domain that specifically binds an additional T cell antigen or an additional tumor antigen.

26. The pharmaceutical composition of claim 25, wherein the third antigen-binding domain specifically binds CD28.

27. The pharmaceutical composition of claim 23, wherein the tumor antigen is selected from CD19, CD123, STEAP2, CD20, SSTR2, CD38, STEAP1, 5T4, ENPP3, PSMA, MUC16, GPRC5D, and BCMA.

28. The pharmaceutical composition of claim 23, wherein the multi-specific antigen binding molecule comprises a multi-specific antibody or antigen-binding fragment thereof.

29. The pharmaceutical composition of claim 23, wherein the multi-specific antigen binding molecule is selected from a bispecific CD3×CD19 antibody, a bispecific CD3×

GPRC5D antibody, a bispecific CD3×CD123 antibody, a bispecific CD3×STEAP2 antibody, a bispecific CD3×CD20 antibody, a bispecific CD3×SSTR 2 antibody, a bispecific CD3×CD38 antibody, a bispecific CD3×STEAP1 antibody, a bispecific CD3×5T4 antibody, a bispecific CD3×ENPP3 antibody, a bispecific CD3×MUC16 antibody, a bispecific CD3×BCMA antibody, a bispecific CD3×PSMA antibody, and a trispecific CD3×CD28×CD38 antibody.

30. The pharmaceutical composition of claim 23, further comprising a pharmaceutically acceptable carrier.

31. A method of treating cancer and inhibiting cytokine release syndrome in a subject, comprising administering to the subject a pharmaceutical composition of claim 23.

32. A method of treating cancer and inhibiting cytokine release syndrome in a subject comprising:
   (a) identifying a subject that is susceptible for cytokine release syndrome or in need of reduction in cytokine release; and
   (b) administering to the subject a pharmaceutical composition of claim 23.

33. The method of claim 1, wherein the method further comprises identifying a subject that is susceptible for cytokine release syndrome or in need of reduction in cytokine release prior to conjointly administering to the subject the multi-specific antigen binding molecule and the CD40 antagonist or the CAR-T cell expressing the CD40 antagonist.

* * * * *